United States Patent 7,745,391 (HUMAN THROMBOSPONDIN POLYPEPTIDE) - sequence listing, part 28

SEQ ID NO: 65641 - DNA, 3523 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttggggggggtgtatggtgctggttacttttccgcagttggcatgggttgccctacaggcccacagggccaccagcacacccccgcacgctgggcaccaacagagccacggagcgcgagcacatgcccgcccggggagcacaatggcgctgcacaaaacggcctcccacacgtgcgtccaggctcttgcgccacctccttctcattctcttttcagactttcatgtagtcccagctttgagccagcagctgccacttggggctgcagagctctgttgagggaactgcccagggctgggtagaggcagcaaggggacagggctgggtgctgttgtgtgcgaactgagctgcactctccttaggcccagttcaggcctcagcccctctttcccaggccctggatctcaccagcagccaaggttgagccagaaccagaaccctgtccctccggcccccagttcctaccccagaaccagttaactgtgcttcaggggtagggctgggcccacagagcctgggggagtgtcaccgcctttgctgcctctcagttagtgtcaatgctatgggtttcctggtaggagccctgccctcgctcctctgctggattctagtcccccacccgacctcaccgtcagagctggtcctccctcggcactgctcacagctgctgcctcagagcctggtgaccctgcctgctcaaatccgaggccatcttgacccagtttcacagtaagccccacctcctcccgctccacctccctcggcctctccttcaccgtggaaaatggagcaggcccttgcagaacaccccagcccttctcacccctcccactgcaggaaaaaggagccaaactgtcctttagtcctgggagtggggaccttgactccccgtcatgggccctccagcccctcaccttcattggtgcccagggcttcctcctggaggcagtcatcagacctgtcagagcagttccctgcctggagaggcagttccccactgccagagagttggaggaaagaatgtggatggaatttggcatctgaagctaagtgattctagggtacctcccaactcctaagcaaaatgggacatgtcctcctggctaaggaggttgaatgggagccagggctctatcccctgccctctcctgactgcaagcatggctaggttttcctgggcctgggatcccgggagaggaccagcaatctcactcatctggggctgtttccaggccaaggtgcctttctcagatcctgtgatcctcactgaggattgaggtttgagataagagagctggttaccaggaagcaagcaagcatcctccttccacagtgccggcgtgcagcaggtgctaatatgacttaaagaatttgttcaggggccaggtgctcatgcctgtaatcccagtactttgggagcccgaggtaggagaatgacttgagtctgggagtttgagaccagcctgggcaaaatagtgagaccctatctctacaaataatccaaaattagacaggcgtggtagtgcgcacctgtagtcccagctactcaggaagctgaggcaggagaatcgcttgagcccaggaagtggaggctgcaatgagctgtgatcacaccacagcactcagcttgagtgactgagtgggatcttgtctcaaaaaaaaaaaagtgttcagccaggcatggtggtacacacttgtagtcccagctactcaggaggctgagacaggaggactgcttgagcccaggagttcaaagccagcctgggcaacatagtgagacccccccacccagctcttaagaaaaaaaaaacac

SEQ ID NO: 65642 - DNA, 1828 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccaggtaccagaaaccaccaggcacacggggcagaaagccagcgtccatgccccagcagccccctcctgcctgttcctggctcccagctcccgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttgaaaaaaaaaccaccgacgacaatgccggtccaacac

SEQ ID NO: 65643 - DNA, 3002 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgcccctccccagggcccccacctccacggcccacttcattttctgttctcattttgcagagttgcacaaggagagaactcagcatggggggttggttctttgggttctgtttgtttatttgtttaatttaatgatttgtaaagtgatgttcctcttccttttttacacttttcagctcatatttaacctctgtttggaaaatgattcttgtaactgtacatttttttgcttcctaataacaatgacaacaaaaaaaataaatgaccagttttgtgttggggggggtgtatggtgctggttacttttccgcagttggcatgggttgccctacaggcccacagggccaccagcacacccccgcacgctgggcaccaacagagccacggagcgcgagcacatgcccgcccggggagcacaatggcgctgcacaaaacggcctcccacacgtgcgtccaggctcttgcgccacctccttctcattctcttttcagactttcatgtagtcccagctttgagccagcagctgccacttggggctgcagagctctgttgagggaactgcccagggctgggtagaggcagcaaggggacagggctgggtgctgttgtgtgcgaactgagctgcactctccttaggcccagttcaggcctcagcccctctttcccaggccctggatctcaccagcagccaaggttgagccagaaccagaaccctgtccctccggcccccagttcctaccccagaaccagttaactgtgcttcaggggtagggctgggcccacagagcctgggggagtgtcaccgcctttgctgcctctcagttagtgtcaatgctatgggtttcctggtaggagccctgccctcgctcctctgctggattctagtcccccacccgacctcaccgtcagagctggtcctccctcggcactgctcacagctgctgcctcagagcctggtgaccctgcctgctcaaatccgaggccatcttgacccagtttcacagtaagccccacctcctcccgctccacctccctcggcctctccttcaccgtggaaaatggagcaggcccttgcagaacaccccagcccttctcacccctcccactgcaggaaaaaggagccaaactgtcctttagtcctgggagtggggaccttgactccccgtcatgggccctccagcccctcaccttcattggtgcccagggcttcctcctggaggcagtcatcagacctgtcagagcagttccctgcctggagaggcagttccccactgccagagagttggaggaaagaatgtggatggaatttggcatctgaagctaagtgattctagggtacctcccaactcctaagcaaaatgggacatgtcctcctggctaaggaggttgaatgggagccagggctctatcccctgccctctcctgactgcaagcatggctaggttttcctgggcctgggatcccgggagaggaccagcaatctcactcatctggggctgtttccaggccaaggtgcctttctcagatcctgtgatcctcactgaggattgaggtttgagataagagagctggttaccaggaagcaagcaagcatcctccttccacagtgccggcgtgcagcaggtgctaatatgacttaaagaatttgttcaggggccaggtgctcatgcctgtaatcccagtactttgggagcccgaggtaggagaatgacttgagtctgggagtttgagaccagcctgggcaaaatagtgagaccctatctctacaaataatccaaaattagacaggcgtggtagtgcgcacctgtagtcccagctactcaggaagctgaggcaggagaatcgcttgagcccaggaagtggaggctgcaatgagctgtgatcacaccacagcactcagcttgagtgactgagtgggatcttgtctcaaaaaaaaaaaagtgttcagccaggcatggtggtacacacttgtagtcccagctactcaggaggctgagacaggaggactgcttgagcccaggagttcaaagccagcctgggcaacatagtgagacccccccacccagctcttaagaaaaaaaaaacac

SEQ ID NO: 65644 - DNA, 1080 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccaaaaaattctctagggggggcccgttacccaattctccctattttgagttatatacaatttcttggcccgtgtttttccacctgttttgcctgtaaaacccttgtagtaccacacctaaatcactttgcagta

SEQ ID NO: 65645 - DNA, 836 bp, Homo sapiens
agcgggaggcgattccggggcagcgagtcgtcggccgccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggcttcagtactcgggcaagaccaccttcgtcaacgtgatcgcgtcaggacagttcaacgaggacatgatccccaccgtgggtttcaacatgcgcaaaatcaccaaagggaatgtgactatcaagctctgggacattgggggacagccgcgtttccgcagcatgtgggagcgctactgccgaggagtgagcgccatcgtgtacatggtggatgctgctgaccaggagaagattgaggcctctaagaacgagctccacaacctactggacaaacctcagctgcagggcatcccggtcttagtcctgggtaacaagcgagaccttccgggagcattggatgagaaggagctgattgagaaaatgaatctgtctgccatccaggaccgagagatctgctgctactccatctcttgcaaagaaaaggacaacattgacatcaccctacagtggcttattcaacactcgaagtcacggagaagctgagactccagcccttctccctcagaccagggaccgtcatcatctaaacctgaagccgagctccccgcccacccctgtctttccagacttgggatacctctagagtcg

SEQ ID NO: 65646 - DNA, 859 bp, Homo sapiens
agcggacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggtgatggggatggggaggaggcggcacacggaggcaggagcttttgagtctgagctcacaggcagagccactcagagccctctgatctcagttccctctgcctggtacaccattcccctcccctgcttccggccaaatccttctcaccgatttcagcccagatgctgcctcctctgagctcctgccagtccccaggatctgccccagtcacctcttctcttagcacttagcatagttgtagctgtacatgtggctgtctgacacatgcccactttcccttatggacttcgagttttcccaccctgtagcttaggtccttagtaaagatatgctaaatgggtcgggggtggtggctcacacctgtaatcccaggactttgggaggccgaggcaggcggatcacttgaggtcaacagttagaggccagcctggccaacatggtgaaaccctgtctgtactaaaaataaaaaaataaaaaaaaaaattgagccgggcatggcgggcgcctgtaatcccagctactcaggaagctgaggcaggagaatcgcttgaac

SEQ ID NO: 65647 - DNA, 1133 bp, Homo sapiens
agcggacagttgaagaagcgaccgagggactgggagtcgttagtgagatggggttttgccatgttggccaggctggacttgaactcctgacctcaagtgatctgcccgcttcagcctccaaagtgctgggattacaggtgtaagccacggtgctcggccttcagtgaagttttaatgatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65648 - DNA, 1095 bp, Homo sapiens
aaaaccagaaacattgctgatatgaccacaataccatcatcacactttaaaagaacaaccgtaattctagactactatccattacgtggtgcagagtcaagtccagtgtaactgtgggtttgttggaatcaggatatagatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65649 - DNA, 985 bp, Homo sapiens
cccacgcgtccggggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65650 - DNA, 969 bp, Homo sapiens
tgcaggctggtactggtcgcgaggtgttatgatccacagtcctgccactgtcccttcctccctaggatgacgcggcatggcaagaactgcaccgcaggggccgtctacacctaccacgagaagaagaaggacacaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65651 - DNA, 1977 bp, Homo sapiens
tgcaggctggtactggtcgcgaggtgttatgatccacagtcctgccactgtcccttcctccctaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcacgtgagctgggaacagggatgggtaggtctgggtggggagagcaagggaaccgccaggaggaggctgtgtgcgtgggtctggccacctgcacagccagggaaccctggatgagcagtttatcctcagagcctctgtattctcacatgggacatgggcatgatcctagcatctgtttcatagtgtggaacatatggaaaggaacatacttctaatggggtgtagggctctcagagcattgccgaggccatcggagcagctcacctttggacacttcccatgacctacctctgatggtagggcaaaggcttaacaggtgctgagtccaggcactaaatacgtgctcaattagtggtatattttgtagaagacagtaattaatgatcagggcccccaaggccaccttcaggtttcttttttttttttgagacagagtcttcactttgttgcccaggctggagtgcaatggggacatcttggctcactgatatcccaggctcaggtgatcctcctgcctcagcccccacgagtagctggaaccacgggtgtgcactaccacacctggcgtttttgtttgttttttgtagagaggggagctcactttgttgcccaggctggtctcgaactcgtggctgcaacaatatgtggcacacattgttgctgagagaatgaagcactttccctgcagctctattgggagaggacagctggaagctcaaatctagtctctactagattctgccccatgtgcctttttcctttgctgattttaatctgcatcctttcactgcagtaaactatcaccatgagtataacagctttgctgagttctgtgaattctagcaaataattgaacttgggactgatcatgatgacttctgcctataatcccagcacttcgggaggccgaggcgggaggatcactttctttctttctcattgcaccctgtctttgcagcccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65652 - DNA, 938 bp, Homo sapiens
agcggacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcgtaccggcttcgcggctcacggaggaagcgcataagagaatgaccgccgaagc

SEQ ID NO: 65653 - DNA, 916 bp, Homo sapiens
agcggacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65654 - DNA, 923 bp, Homo sapiens
agcggacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65655 - DNA, 840 bp, Homo sapiens
agcggacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaaagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65656 - DNA, 2415 bp, Homo sapiens
tgcaggctggtactggtcgcgaggtgttatgatccacagtcctgccactgtcccttcctccctaggatgacgcggcatggcaagaactgcaccgcaggggccgtctacacctaccacgagaagaagaaggacacagggtgcagggctggggtgggaagaggcgggacatggctgtgtcttggagtcaccctctcccctcgtgccccaggttttgcttcctctgtccctgtctctctcccgcccccgatatacactgatggccatgaccatgtaaacaacagctgggtgatcccatgaccccatgtggcccggcactgtgttctctgccttctgcgcatgaactcactcctcccaacagagtgtcagggagggtgctcttgttaccccatgttccagaggaagaaactgaggcccaaagagggacaggcacttgagcttggtcacagtcagaagggtggaggggagtcagccgtcagcccctccaccaagctgccactcagtgaccaggcctgtctgcctctcaccctccagggttgacaactccctgtgggttcagcccgtggccccagcacacaggcagcggctcccaactgcctgtttctctctgagtcccccacccccaccaccgcgttgtctctgtgcctctctctggggctttggagacggacatgtctcctgttgctccgcccctccatcactctgcccatctctgtccccagcggcctcgggctatgggacccagaacattcgactgagccgggatgccgtgaaggacttcgactgctgttgtctctccctgcagccttgccacgatcctgttgtcacgtgagctgggaacagggatgggtaggtctgggtggggagagcaagggaaccgccaggaggaggctgtgtgcgtgggtctggccacctgcacagccagggaaccctggatgagcagtttatcctcagagcctctgtattctcacatgggacatgggcatgatcctagcatctgtttcatagtgtggaacatatggaaaggaacatacttctaatggggtgtagggctctcagagcattgccgaggccatcggagcagctcacctttggacacttcccatgacctacctctgatggtagggcaaaggcttaacaggtgctgagtccaggcactaaatacgtgctcaattagtggtatattttgtagaagacagtaattaatgatcagggcccccaaggccaccttcaggtttcttttttttttttgagacagagtcttcactttgttgcccaggctggagtgcaatggggacatcttggctcactgatatcccaggctcaggtgatcctcctgcctcagcccccacgagtagctggaaccacgggtgtgcactaccacacctggcgtttttgtttgttttttgtagagaggggagctcactttgttgcccaggctggtctcgaactcgtggctgcaacaatatgtggcacacattgttgctgagagaatgaagcactttccctgcagctctattgggagaggacagctggaagctcaaatctagtctctactagattctgccccatgtgcctttttcctttgctgattttaatctgcatcctttcactgcagtaaactatcaccatgagtataacagctttgctgagttctgtgaattctagcaaataattgaacttgggactgatcatgatgacttctgcctataatcccagcacttcgggaggccgaggcgggaggatcactttctttctttctcattgcaccctgtctttgcagcccagatggctacctgtatgagcgtgaggccatcctggagtacattctgcaccagaagaaggagattgcccggcagatgaaggtgatggggatggggaggaggcggcacacggaggcaggagcttttgagtctgagctcacaggcagagccactcagagccctctgatctcagttccctctgcctggtacaccattcccctcccctgcttccggccaaatccttctcaccgatttcagcccagatgctgcctcctctgagctcctgccagtccccaggatctgccccagtcacctcttctcttagcacttagcatagttgtagctgtacatgtggctgtctgacacatgcccactttcccttatggacttcgagttttcccaccctgtagcttaggtccttagtaaagatatgctaaatgggtcgggggtggtggctcacacctgtaatcccaggactttgggaggccgaggcaggcggatcacttgaggtcaacagttagaggccagcctggccaacatggtgaaaccctgtctgtactaaaaataaaaaaataaaaaaaaaaattgagccgggcatggcgggcgcctgtaatcccagctactcaggaagctgaggcaggagaatcgcttgaac

SEQ ID NO: 65657 - DNA, 1114 bp, Homo sapiens
tgcaggctggtactggtcgcgaggtgttatgatccacagtcctgccactgtcccttcctccctaggatgacgcggcatggcaagaactgcaccgcaggggccgtctacacctaccacgagaagaagaaggacacagggtgcagggctggggtgggaagaggcgggacatggctgtgtcttggagtcaccctctcccctcgtgccccaggttttgcttcctctgtccctgtctctctcccgcccccgatatacactgatggccatgaccatgtaaacaacagctgggtgatcccatgaccccatgtggcccggcactgtgttctctgccttctgcgcatgaactcactcctcccaacagagtgtcagggagggtgctcttgttaccccatgttccagaggaagaaactgaggcccaaagagggacaggcacttgagcttggtcacagtcagaagggtggaggggagtcagccgtcagcccctccaccaagctgccactcagtgaccaggcctgtctgcctctcaccctccagggttgacaactccctgtgggttcagcccgtggccccagcacacaggcagcggctcccaactgcctgtttctctctgagtcccccacccccaccaccgcgttgtctctgtgcctctctctggggctttggagacggacatgtctcctgttgctccgcccctccatcactctgcccatctctgtccccagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaagtttcatcgtctgtaaaacgggctgacggccaaatcagaggacacagcagggcacctgggaggtacacgcagatgagcattctcaaggcgtgttactgggaacccggcctggccttccatggacaaagccatttgatgggtggctccccctgtgcccatgtcctccacacagcctggtggtcatgtcggaggccctcatgagcatcca

SEQ ID NO: 65658 - DNA, 753 bp, Homo sapiens
ggccttccatggacaaagccatttgatgggtaggaggggccctgtttgaggcacagtgggtctgtccccctcttcccctgcctggttgctggcgctcaggaaacactacaggtcacatgcttattgggctttttgtcccaagcaggtggctccccctgtgcccatgtcctccacacagcctggtggtcatgtcggaggccctcatgagcatccatcactgtcactgttacctcctcactcagctgggtggcccagggtggtctggaactgcagcaccgcccaggcaactgctgtgcgccaggcagggctgagctcaggtcatggcttcacttctcccgtcctcactcactgtccgtccatagacatgggctcctcagcattcccttagatctgaagtctacatcccccgtcccaaacacgggctggggcatgcactgtatagaaaacttaattggccagcaggtgacattaattaaatgcttagctgagtgccaggtgaggctctccatgctgtaaacactcaccttatgtaacccttcagtgagccgctgaggtgggtaaccactgttaggctgttttacagatgaagaaactgaggccaggagaggtcatagtgctcacttaggccacagagtgacagagatgggctttgagccctggcagtctggctatacaacgcagtaaggttcacacccacccagggtggcagttaccaccctctgccacatagtgcctccatcagagggtcccctt

SEQ ID NO: 65659 - DNA, 389 bp, Homo sapiens
ccatttcagcctcccgagtagctgggattacaggcgcacaccaccacgaccagctaactttttgtatttttagtacagatggggttttgccatgttggccaggctggacttgaactcctgacctcaagtgatctgcccgcttcagcctccaaagtgctgggattacaggtgtaagccacggtgctcggccttcagtgaagttttaatgtgcgtttccctggtgactatattagtttcctatcattgttgtaacaaattactactaatttagtgttgcagtgtcacacctcatggagcctctggtgtacttgtgagagaatgagaatcagaaaggcaaataatgtcttagtattattaagacaacagttttgaccttgcagactgtctag

SEQ ID NO: 65660 - DNA, 1004 bp, Homo sapiens
agcggacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65661 - DNA, 1605 bp, Homo sapiens
tgcaggctggtactggtcgcgaggtgttatgatccacagtcctgccactgtcccttcctccctaggatgacgcggcatggcaagaactgcaccgcaggggccgtctacacctaccacgagaagaagaaggacacagggtgcagggctggggtgggaagaggcgggacatggctgtgtcttggagtcaccctctcccctcgtgccccaggttttgcttcctctgtccctgtctctctcccgcccccgatatacactgatggccatgaccatgtaaacaacagctgggtgatcccatgaccccatgtggcccggcactgtgttctctgccttctgcgcatgaactcactcctcccaacagagtgtcagggagggtgctcttgttaccccatgttccagaggaagaaactgaggcccaaagagggacaggcacttgagcttggtcacagtcagaagggtggaggggagtcagccgtcagcccctccaccaagctgccactcagtgaccaggcctgtctgcctctcaccctccagggttgacaactccctgtgggttcagcccgtggccccagcacacaggcagcggctcccaactgcctgtttctctctgagtcccccacccccaccaccgcgttgtctctgtgcctctctctggggctttggagacggacatgtctcctgttgctccgcccctccatcactctgcccatctctgtccccagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65662 - DNA, 2560 bp, Homo sapiens
tgcaggctggtactggtcgcgaggtgttatgatccacagtcctgccactgtcccttcctccctaggatgacgcggcatggcaagaactgcaccgcaggggccgtctacacctaccacgagaagaagaaggacacagggtgcagggctggggtgggaagaggcgggacatggctgtgtcttggagtcaccctctcccctcgtgccccaggttttgcttcctctgtccctgtctctctcccgcccccgatatacactgatggccatgaccatgtaaacaacagctgggtgatcccatgaccccatgtggcccggcactgtgttctctgccttctgcgcatgaactcactcctcccaacagagtgtcagggagggtgctcttgttaccccatgttccagaggaagaaactgaggcccaaagagggacaggcacttgagcttggtcacagtcagaagggtggaggggagtcagccgtcagcccctccaccaagctgccactcagtgaccaggcctgtctgcctctcaccctccagggttgacaactccctgtgggttcagcccgtggccccagcacacaggcagcggctcccaactgcctgtttctctctgagtcccccacccccaccaccgcgttgtctctgtgcctctctctggggctttggagacggacatgtctcctgttgctccgcccctccatcactctgcccatctctgtccccagcggcctcgggctatgggacccagaacattcgactgagccgggatgccgtgaaggacttcgactgctgttgtctctccctgcagccttgccacgatcctgttgtcacgtgagctgggaacagggatgggtaggtctgggtggggagagcaagggaaccgccaggaggaggctgtgtgcgtgggtctggccacctgcacagccagggaaccctggatgagcagtttatcctcagagcctctgtattctcacatgggacatgggcatgatcctagcatctgtttcatagtgtggaacatatggaaaggaacatacttctaatggggtgtagggctctcagagcattgccgaggccatcggagcagctcacctttggacacttcccatgacctacctctgatggtagggcaaaggcttaacaggtgctgagtccaggcactaaatacgtgctcaattagtggtatattttgtagaagacagtaattaatgatcagggcccccaaggccaccttcaggtttcttttttttttttgagacagagtcttcactttgttgcccaggctggagtgcaatggggacatcttggctcactgatatcccaggctcaggtgatcctcctgcctcagcccccacgagtagctggaaccacgggtgtgcactaccacacctggcgtttttgtttgttttttgtagagaggggagctcactttgttgcccaggctggtctcgaactcgtggctgcaacaatatgtggcacacattgttgctgagagaatgaagcactttccctgcagctctattgggagaggacagctggaagctcaaatctagtctctactagattctgccccatgtgcctttttcctttgctgattttaatctgcatcctttcactgcagtaaactatcaccatgagtataacagctttgctgagttctgtgaattctagcaaataattgaacttgggactgatcatgatgacttctgcctataatcccagcacttcgggaggccgaggcgggaggatcactttctttctttctcattgcaccctgtctttgcagcccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65663 - DNA, 922 bp, Homo sapiens
agcggacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcacgcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65664 - DNA, 936 bp, Homo sapiens
agcggacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgactgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65665 - DNA, 816 bp, Homo sapiens
agcggacagttgaagaagcgaccgagggactgggagtcgttagtgaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65666 - DNA, 1123 bp, Homo sapiens
  misc_feature (54)..(54): n is a, c, g, or t
agcggacagttgaagaagcgaccgagggactgggagtcgttagtgagagtttcnctcttgttgcctaggctggagtgcaatggtgcgatcttggctcatcacgaccttcgcctcccaggttcaagtgattgtcccatttcagcctcccgagtagctgggattacaggatgacgcggcatggcaagaactgcaccgcaggggccgtctacacctaccacgagaagaagaaggacacagcggcctcgggctatgggacccagaacattcgactgagccgggatgccgtgaaggacttcgactgctgttgtctctccctgcagccttgccacgatcctgttgtcaccccagatggctacctgtatgagcgtgaggccatcctggagtacattctgcaccagaagaaggagattgcccggcagatgaaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccagatgatgtccaacctgggcccagtgtgggtcctccaagtaaggacaaggacaaagtgctgcccagcttctggatcccgtcgctgacgcccgaagccaaggccaccaagctggagaagccgtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctctggggctgtggtcaccctcgaatgcgtggagaagctgattcggaaggacatggtggaccctgtgactggagacaaactcacagaccgcgacatcatcgtgctgcagcggggcggtaccggcttcgcgggctccggagtgaagctgcaagcggagaaatcacggccggtgatgcaggcctgagtgtgtgcgggagaccaaataaaccggcttgggtgcgcaaaaaaaaaaaa

SEQ ID NO: 65667 - DNA, 563 bp, Homo sapiens
  misc_feature (552)..(552): n is a, c, g, or t
tgctttagttggtacaaagtactcatgattttgatttttaaaaagaaagtcaagattattacatatttaatacaaattcttacatatgccaagaacaataaatgcatttcttttaaactgagaagtaactctgatgtgtttttacaagagaattacttccatttctctgtaatttcactgctttcaaatccaagagcaaaattcatacttagaatgacatttaaaaggaaagccaaacgggcttttattcattatatcacaacacttcttacttcattaaaacattctttatgcttgataattttcagattgataatacattaccagattaaggaataggaggagtatgatatacaatgatatacaactaacagtttttggttctttttttgagacagggtctcactctgtcacccaggctggggtgaagtgtatgtgatgtcagctcactgcagcctctgcctcccaaggtcaagcaattcatgtgcctaagcctcctgagtagctggaattacaggcatgtgccaccacacctggctaatgtcgacgcgnccgcgaattta

SEQ ID NO: 65668 - DNA, 1060 bp, Homo sapiens
cctcttgtttttagtctcgcttttcggttgccgttgtcttttttccttgactcggaaatgtccggtcgtggtaagcagggtggcaaggcgcgcgccaaggctaagtcgcgctcgtcgcgcgcggggctgcagttccccgtgggccgcgtgcaccggttgctccgcaagggcaactattcggagcgcgtgggcgccggcgccccggtctatctggccgcggtgctcgagtacttgactgccgagatcctggagcttgccggcaacgcggcgcgcgacaacaagaagacgcgcatcatcccgcgccacctgcagctggccatccgcaacgacgaggagctcaacaagctgctgggccgcgtgaccatcgcgcagggtggcgtcctgcccaacatccaggccgtactgctgcccaagaagacggagagccaccacaaggccaagggcaagtgaggccgcccgccgcccccggggcccctttgatggacataaaggctcttttcagagccacctaccatctcgagaaaagagccgcactgatcctgcagttctttataggccggaggcctgatcaccctaggctcatgaatgagcgcagtggccatggggaagggcgcaacgggaaccgagaccctggggactgattgggctgcatacttgcgaggtgggcaacgtgttctgttaacaacagggaaccctcgtccacaggtggccaccccttgctcttgagtcccacccaaaacctctagtagggttttaataacgctcaccgtaaaggtgtcttcataattactagtgacaagttctcttgactctagcaaggttcccgtgtggtcatcaagtacagaatgcaatttcttaatgatttatctgatattaaaagtatttatgatctctaaaaaaaaaaaaaaaaaaaccaaaacaaaaaaaaagaaaataacacaaaaaccaaaaaacccccccaacacacaaaaacaacaacaccaaacacacccacaaacaccacacacgaagccacaaattacacccccccccccaccatggcccaccccccccctccata

SEQ ID NO: 65669 - DNA, 776 bp, Homo sapiens
cctcttgtttttagtctcgcttttcggttgccgttgtcttttttccttgactcggaaatgtccggtcgtggtaagcagggtggcaaggcgcgcgccaaggctaagtcgcgctcgtcgcgcgcggggctgcagttccccgtgggccgcgtgcaccggttgctccgcaagggcaactattcggagcgcgtgggcgccggcgccccggtctatctggccgcggtgctcgagtacttgactgccgagatcctggagcttgccggcaacgcggcgcgcgacaacaagaagacgcgcatcatcccgcgccacctgcagctggccatccgcaacgacgaggagctcaacaagctgctgggccgcgtgaccatcgcgcagggtggcgtcctgcccaacatccaggccgtactgctgcccaagaagacggagagccaccacaaggccaagggcctgatcaccctaggctcatgaatgagcgcagtggccatggggaagggcgcaacgggaaccgagaccctggggactgattgggctgcatacttgcgaggtgggcaacgtgttctgttaacaacagggaaccctcgtccacaggtggccaccccttgctcttgagtcccacccaaaacctctagtagggttttaataacgctcaccgtaaaggtgtcttcataattactagtgacaagttctcttgactctagcaaggttcccgtgtggtcatcaagtacagaatgcaatttcttaatgatttatctgatattaaaagtatttatgatctctaa

SEQ ID NO: 65670 - DNA, 896 bp, Homo sapiens
cctcttgtttttagtctcgcttttcggttgccgttgtcttttttccttgactcggaaatgtccggtcgtggtaagcagggtggcaaggcgcgcgccaaggctaagtcgcgctcgtcgcgcgcggggctgcagttccccgtgggccgcgtgcaccggttgctccgcaagggcaactattcggagcgcgtgggcgccggcgccccggtctatctggccgcggtgctcgagtacttgactgccgagatcctggagcttgccggcaacgcggcgcgcgacaacaagaagacgcgcatcatcccgcgccacctgcagctggccatccgcaacgacgaggagctcaacaagctgctgggccgcgtgaccatcgcgcagggtggcgtcctgcccaacatccaggccgtactgctgcccaagaagacggagagccaccacaaggccaagggcaagtgaggccgcccgccgcccccggggcccctttgatggacataaaggctcttttcagagccacctaccatctcgagaaaagagccgcactgatcctgcagttctttataggccggaggcctgatcaccctaggctcatgaatgagcgcagtggccatggggaagggcgcaacgggaaccgagaccctggggactgattgggctgcatacttgcgaggtgggcaacgtgttctgttaacaacagggaaccctcgtccacaggtggccaccccttgctcttgagtcccacccaaaacctctagtagggttttaataacgctcaccgtaaaggtgtcttcataattactagtgacaagttctcttgactctagcaaggttcccgtgtggtcatcaagtacagaatgcaatttcttaatgatttatctgatattaaaagtatttatgatctctaa

SEQ ID NO: 65671 - DNA, 858 bp, Homo sapiens
cctcttgtttttagtctcgcttttcggttgccgttgtcttttttccttgactcggaaatgtccggtcgtggtaagcagggtggcaaggcgcgcgccaaggctaagtcgcgctcgtcgcgcgcggggctgcagttccccgtgggccgcgtgcaccggttgctccgcaagggcaactattcggagcgcgtgggcgccggcgccccggtctatctggccgcggtgctcgagtacttgactgccgagatcctggagcttgccggcaacgcggcgcgcgacaacaagaagacgcgcatcatcccgcgccacctgcagctggccatccgcaacgacgaggagctcaacaagctgctgggccgcgtgaccatcgcgcagggtggcgtcctgcccaacatccaggccgtactgctgcccaagaagacggagagccaccacaaggccaagggcaagtgaggccgcccgccgcccccggggcccctttgatggacataaaggctcttttcagagccacctaccatctcgagaaaagagccgcactgatcctgcagttctttataggccggaggcctgatcaccctaggctcatgaatgagcgcagtggccatggggaagggcgcaacgggaaccgagaccctggggactgattgggctgcatacttgcgaggtgggcaacgtgttctgttaacaacagggaaccctcgtccacaggtggccaccccttgctcttgagtcccacccaaaacctctagtagggttttaataacgctcaccgtaaaggtgtcttcataattactagtgacaagttctcttgactctagcaaggttcccgtgtcccaccctctcgagatcctctagagcacc

SEQ ID NO: 65672 - DNA, 479 bp, Homo sapiens
ggccaggcctttaggcctctggaaaacagctgctgccgcaaacacagctccacagcctgctgttgcctcgtgctaaacccagcactagccactggggagcagcctgtcgctgtcccacaggcctgcgctagcttccagggaattcttggagctgtactaatactgcagaaaaactagtttagccttggctttcagaagatgccagtgacaatggagtacattgccctaaagcagtattttcaaaatgtgcattgtggaatccatttggtctaagatcaaaataaatttttaatgaaacagaaaaaggtcagagtgcatcacacatatcatggataaaccagattttggtttctaataccactcccattaaaagaagccagggctccttgcagaaatagctgattccagggctagggcaggataagcacaagataagcctgaagcatcttgttaggatagaaataaaaaagaagtactca

SEQ ID NO: 65673 - DNA, 359 bp, Homo sapiens
  misc_feature (21)..(21): n is a, c, g, or t
cgttttgatgtgagagagagnaaaaaaaaaaaaaaagttgtcctgtttggaatatgttgcctgctgtctgtaatgtgcactactgatagtgtacagagcatgtggcagcatgaacctccgtagctctgatgtgaagagatgtagtatagtgggtatagagtaggagggcggtttttaagtgatgctcttttagtcttttataagggttttgaatgatttgaaattttaagactgcttttattcagtctcaacttttgtgtatatttgtatttcacttttaaaattcatctcataaaatccactatttggtatcatagcagatcctaatactcaagtttttattctctcccgttctacca

SEQ ID NO: 65674 - DNA, 184 bp, Homo sapiens
caggagaatggcatgaacccgggaggcggagcttgcggtgagccaagattgcgccactgcacttcagcctgggcaacagagcaagactccgtttcaaaaaaaaaaaggaatcggacgaaagaaccacaggatgttgaagacaactgtctggaagtatttgtgagggacaacggatgtggccctc

SEQ ID NO: 65675 - DNA, 1513 bp, Homo sapiens
caggagaatggcatgaacccgggaggcggagcttgcggtgagccaagattgcgccactgcacttcagcctgggcaacagagcaagactccgtctgggaaaaaacaaacaaaaaaaaacctctgagataccttggtttctattaataatattttcagcagtttaatctcaactctgttggcttccctttcttaaagagttaggcagtgatatacatgtcatttagaagtaaagggagggctttagtactgcctgttctgaagtaggagtcttagaaattcagtggcaaactgtataggaagggcctgagtttcatattgtctatattgccttgaaatagccttagtctcctgcttaaaaaggcatcctggaaatcatataaaaagtaacaacaaattaaaatgcatgtgtctgtacctaaggcagctgtaagtggaaatatttttacctcatagtgaaatagaatggatgtattaagaagggagaattttttttcagagtgttttatctcagtgtggctcagaaaagccatttatagggtagggtaatcactagagttgagggttcctctcctcccaccccccataagattggtatccataaagcagagatttctaagcagtgagagacttcagtattttagattagattcttgggttataatagaataagatcattagtagtagaacatctggtatcagaaaacttgagtgtttttattgccatgttagcatatgaatcttaaaggattacagaattcagttaagagaaacaagcttttattggatgggtatttaaagagtttcttgataagagagaccttagatttcttacgtaaagccatgttcacaaggaccactgtccttgtgattctaatttgccagataaaagtctatgtcctggcgcagtggctcgtgcctgtaatcctggcattttgggaggctgaggtgggcggattatttgaggccaggagctggagatcaacttagccaacatggtgaaatctcatctctactaaaaacacagaagttacctgggtgtggcgacacgcatctgtaatcccagctactagggaggctaaggcaggaaaatcacttgaacctgggaggtggaggttgcagtgagccaagatcccaccactgcacttcagcctgggtgacagagcgagactctgtctcaaaaaaaaaaaaaagttgtcctgtttggaatatgttgcctgctgtctgtaatgtgcactactgatagtgtacagagcatgtggcagcatgaacctccgtagctctgatgtgaagagatgtagtatagtgggtatagagtaggagggcggtttttaagtgatgctcttttagtcttttataagggttttgaatgatttgaaattttaagactgcttttattcagtctcaacttttgtgtatatttgtatttcacttttaaaattcatctcataaaatccactatttggtatcatagcagatcctaatactcaagtttttattctctcccgttctacca

SEQ ID NO: 65676 - DNA, 546 bp, Homo sapiens
ttgagaaagtaatataactaattttgaaagtctaataatcaagctgtaaaaggaaatgtatgagttaacaaatatttattttgcattctttgtgtgccttatcatgtgttaagtaccatgagggtacacccaggcttagcacaatgcatttggtatacaaaaccatgtaaaatgtcatagcttttgatagcttttaaatgaaacttaattttggcccagtttaaagatattaccgaacatttgggataaaatgtgatggtttcctggcttctatcatggacgatgttatggaagacaattaccacgtttttgaaatcatgtctataaatatttaatatccatttaaattatgtatagaaaattattttgttcatgttttagaaattaaacatttctttcacctgagtatatgttttacttgtatggcttcaccatgtctctctggtaaaccacagttaatattttaagctatagtgggaaataaaaactcttttgtgattgcggtaactatttttataccatgcttaacattccctaatagcagat

SEQ ID NO: 65677 - DNA, 629 bp, Homo sapiens
agtgggggaaactcgggcacccctaaactattctccagtgttctcaccagaggtggtcagccatgtgatggcaagagtcacttcttaagcttttgctatccccagaaacttaaagcaacaccaaccacacccaaaagtcaagtgatatccagacagcaacagtagagcattaactgagtgcagggccgtggtgactcctcgacactccaggctctcctgctggtaacctcccattggcagagccaggcactcagcaaagccctggacagtcagcagcctcctgaacaggctctgctgtccccactcacgacttcagagcagctaggactcctgtgaccacccctgtcccctgttcccccccaccccgccccgccccgccaactgcctcatctctgtcccaagataactgctctccagaattttccatgatatggtcattttaaaagttttttttttttttgagacagagtttttcctgtgttgcccagactggactcaaacctctgggctcaagtgatcctcctgcttcagcctcccaagtagctgggactgtaagtgtgcaccactgtgcctggcttgatggtgtcatttttcactgtacgtgtatttgtaaaccgtataaatcagaa

SEQ ID NO: 65678 - DNA, 243 bp, Homo sapiens
tgatctgagccagcctgtaactgtgcacactcctctgacaatcagcttaatgagatgctacagagatccctcaaaggagccaaacaaatgaattagcatgagtgcttttggtctaaaataaggtaccttaaacctgctgataataaccctaaaggaaataaaattcatcattgttattccattaggagattttgaaccagaagaatctaaccatatgctggctttggtaatgctactacattt

SEQ ID NO: 65679 - DNA, 393 bp, Homo sapiens
gcacagctaacaagagcatgggggagaccccaccatgactaccccacactgacataactggtaactgccatgcaggagcgctagccacaacggccacaccttctgagtacttgcagagatctttgggtttatgccttctctgcaattttgaaaatattatttagtaactataggctaatctgagcctaaaaataattacctaaggaacctgttaagtgtgtttgtgcaatctcctggaattagcattttcttgaaagggaacctgtgtaatcctttcaagtgtctggtgtgtttctctgagtaaccagttatactttgtgaggactttccaattcatcagactatagtatagtttcatgtgctcttaaacatcatcagcaagcaaaaaatagt

SEQ ID NO: 65680 - DNA, 239 bp, Homo sapiens
atacaaggagagaaaatatattggttgggaaaccattgctcatctttgagaaaaatcataaagacttggagccctagatatatagtattattttttcctgatattctccttccataagagataatacctgaagtactatgaatattatatatttaaattacagcactctaagcaaaaatttcacacagatttcctacttgtttaaatgtttaataaattacaaaataaacgtttccaaa

SEQ ID NO: 65681 - DNA, 292 bp, Homo sapiens
actgctctccagcctgggcaacagagtgagactccatctcaaaaaaaattacaaaataaagatccaggggccctgaagttgttacaatcaagctaggatggttcaagacagatttgaataggtacgggtgatgatgtcatcaaggccagactctcaagattgggcttgctgtcttggaaatgagaacaatttggatagcatggagcatgtgctgaggagtggccacctccctgctgtgtggagtgtgaatagaaatccctcagagaatggcttcaggctgaagatgtaagaa

SEQ ID NO: 65682 - DNA, 422 bp, Homo sapiens
actgcccaactaaacatgcgatccttgcttaaactgactggaattcaaatcccatctctgctccttactactagtgtgactgtgataatattttatgatgtggtcttagatgctcttatctataaattgagaaaaatagaccagacgcactgcctcacacccatagtcccagcactttgggaggctgaggcatgcagatcacttgagctcaggagtttgagaccagcctgggcaacatggcaaaaccccatctctaacaaaaatacaaaaaattagctgggcatggtagtgtgtgcctgtggtcccagctgcttgggaggctgaggtggcaggatcctttgagcctcagaggtggaggctatactgagtgcacatggtgctactggactccaacctgggtgacagagtgagaccctatctca

SEQ ID NO: 65683 - DNA, 2644 bp, Homo sapiens
  misc_feature (2284)..(2284): n is a, c, g, or t
ctccaccgtttgttgtggccagtgttactgtggtgaccgccagagcagccttcgcgctatggaggagcccggtgctacccctcagccctacctggggctggtcctggaggagctacgcagagttgtggcagcactacctgagagtatgacggcagattcgaatccttatggttttccatgggaactggtggtatgtgcagctgttgttggattttttgttgttctcctttttttgtggagaagttttagatcggttaggagtcggctttatgtgggaagagagaaaaaacttggtgaaacgctttctggactaattgaagaaaaatgtaaactacttgaaaaatttagccttattcaaaaagagtatgaaggctatgaagtagagtcatctttagaggatgccagctttgagaaggcggtagcagaagcacgaagtttggaggcaacctgtgaaaagctgaacaggtccaattctgaacttgaggatgaaaccctctgtctagaaaaagagttaagagaaatctaaacattctcaacaagatgaattgatggcggatatttctaaaaggatacaatctctagaagatgagtcaaaatccctcaaatcacaaatagctgaagccaaaatcatctgcaagatttttcaagcgactgaagaacgatgggcaatagcaataaaagatgctttgaataaaaattctcaacttcacgaaagccagaaacagcttttgcaagaagctgaagtatggaaagaacaagtgagtgaacttaataaacagaaaataacatttgaagactccaaagtacatgcagaacaagttctaaatgataaaatcacatcaagaccctgactggacacttgccaatgatgaacgatcaggctgctgtgcttgaagaagacacaacggatgatgataacttggaattagaagtgaacagtcaatcggaaaatggtgcttatttagatgatcctccaaaaggagctttgaagaaactgattcatgctgctaagttaaatgtttctttaaaaaccttagaaggagaaagaaaccacattattattcagttatctgaagtggacaaaacaaaggaagagcttacagagcatattaaaaatcttcagactcaacaagcatctttgcagtcagaaaacatatattttgaaagtgagaatcagaagcttcaacagaaacttaaaataatgactgaattatatcaagaaaatgaaatgacactccacaggaaattgacaatagaggaaaattactggatagaggaagaagagaagctttctaaagtggaagaaaagatcagccatgccactgaagagctggagacctatagaaagctagccaaagatcttgaagaagaattggagagaactgttcatttttatcaaaagcaggttatttcctacgagaaaaaaggacatgataattggttggcagctcggactgctgaaagaaacctcaatgatttaaggaaagaaaatgctcacaacaaacaaaaattaactgaaacagagtttaaatttgaagttttagaaaaagatcctaatgcacttgatgtttcaaatacagcatctggcagagagcattccccatatggtccctcaccattgggtcggccttcatctgaaacgaggacttctctctcctcaaactttgttggaggatccactcagactctcacctgtgcttccagcgggaggaggaagaagcccaagcggccgagagaatcctctggaccatcagattaccaatgaaagaggagaaccaagctgtgataggttaactgatcctcacagagctccttctgacactgggtccctgtcatctccatgggaacaggaccataggatgatgtttcctccaccaggacaatcatatcctgattcagctcttcctccacaaagggaagacagattttattctaattctgatagactgcctggaccatcagaactcagaagttttaatatgccttctttggataaaatggatgggtcaatgccttcagaaatggaatccactagacatgatgccaaagatgatcctggtagtttaaatgtgcctgattcatctctccctgctgaaaatgaagcaactggccccggctttattcctccacctcttgctccaatcagtggtccattgtttccagtggacacaaggtgcccgttcatgagaagaggacctcttttcccccaacctcctccaggaacgatgtttggagcttcacaaggttattttccaccaagggatttcccaggtccaccacatgntccatttgcaatgagaaacatctgtccactgaggggtttacctccttactttcatccaagacctggattttaccccaaccccacattctgaaggtagaagcgagttcccttcatggttgattctgcctttaaaggagcctgctactgaacatccagaaccacagcaagaaacctgacaatatttttgctttcttcaaaagtaattttgactgatctcattttcagtttaagtaactgctgttacttaagtgattacacttttctcaaattgaagtttaatggaattgtagttctcaggatagtattttgtaaataaagatggtttaaatatgaataaaaaataaaaaatatctattctac

SEQ ID NO: 65684 - DNA, 374 bp, Homo sapiens
gacatttaacaaaacaactttacgtgatactgagatggcattttttcaactggtgtctaattcttgaaattgaagcatcaagaaaaaatcatttaaaaatgttttaatctctctcgttcagtagtagcttcaaattagtttgtgatgtaggagaggtataaatgacaaattaatgaattctcaaactgatatcgaataatatgcacaattttatgcatactaaaaataatctcttaaaatctgtacgtctgtgccatgaaatcactgttcaccaaaagcaagacatttggaattttatattaggtttatattatccatggtttttttttttggtatatgaggaatgaaaaagtgaaataaatgttttgataaag

SEQ ID NO: 65685 - DNA, 351 bp, Homo sapiens
cccaatacagattaatgatgatcacacaatcttagagtgcatgggaaataaagttcttttagaaaaactcagtgtcaccattcactctgttttcagtgggggaaaaaagtcaggagtggaacaagagccagaaatgatttccatgtctctctaggaaaaaaagcaggtggatttaaaggaaaagtatgtcctcagagaaacaagatatgtatccaggatcaatgtgttctaaatgctcttcagagaagagctaatgaatcccatgataagagggcaaatgtcagattatctactacccaagctattttctaggatcctcaatgactctggcctcacacaaactaattatta

SEQ ID NO: 65686 - DNA, 3755 bp, Homo sapiens
gatattttccaatttgtcactggatgagcgttgcctttccgcatcattggtttgcaagtactggcgtgacctttgtttagacttccagttttggaagcagctggatcttagtagtcgtcagcaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcagctgggctcaaaatgcagagaactcaaagatattcatttcggccagtgttacaagatctcagatgaaggcatgatcgtcatagctaagggctgtctgaaattacaaaggatatacatgcaggaaaacaaattagtgacagatcagtcagtgaaagcatttgctgaacactgtcctgagcttcaatatgtaggcttcatgggttgttcagtcacttctaaaggagtcattcacctaaccaagctaagaaacctttccagcttggacctacgtcatatcactgaactggataatgaaaccgtgatggaaattgtcaagaggtgcaaaaatcttagctctctcaatctctgtctgaactggatcataaatgacaggtgtgtggaggtcattgcaaaggaaggacaaaacctgaaagagctatatttggtgtcctgtaaaatcacagattatgcactgatagccattgggcgatacagcatgacaatagagactgtggatgtcggatggtgtaaagaaatcacagaccaaggagccaccctgattgcacagagcagcaagtctctgagatatttggggctgatgagatgtgataaagtaagagttgactatcaagttgtttgctttctacatatcagtatagttaatagcttgatgtcatatcctctctccttctctatctccacccccgtgtattatatattatatatacattttatatgtatatatgcaattatagctatgcattgtttgcctgcttttgtaaactaatctgagattatctttgtatttccccacttaataatgaattttgtgcttaagtagaaagaaaaagtaatcatatacatagtcaactagagtttggcatcctattcataagtccatggaccaaaatgtaaaagattacatgacaaactgcaatttgcagggtctaaccgtaaaattgtattctgggtttcaagtttccagcaacagtaaaggtggaaagaacagtgccaaattggtttttcacaagtgtgtaattttggtactgaacatctatgtattctggccattcgggaccaacaaagggccagtaagggggtatgtgggaatttgcatctccccatacatcagatgccactcccagcacatgataagaagtggttccagaggtcctggtggaaggcctgtagaaccagccagggatgtgagcatgagtttaggaaatggtgtagcatttaacgtgggaccctttgaagactgagaaaacagataataaaaatctatactgacacctgtaatcccagcacattgggaggccaaggcagaaggatcacttgagcccaggaatttgagaccagcctggacaacatgggaaaaccctgtctctatccccctctcccccaacaaaaaaaatcagccaggcataatggcacacacctgtagtcccagctactcgggaagctaaggtgggaggatcacctgagctcaagaggccgaggttgcagtgagccgtgattgtgccgcaaccacctcagcctggatgacggagcacgactgtgtcccaaacaaacaaaaaaaacctatactggacaccaggcactccacaggtgttttcttctttgtttattccatgttttacctataacaagtctaagaaatagttatttgcattgtgaaggggagaaaatggaggctcagaaagaccagtcagtggccccgggatactctggcaagacttcatgccgggtctttggagtctgtatccagtgctgctggcacaacccagggggcagtctgtggccacggggactgcttcccttggaaaaggtccagttcagatacttgctcagaaagtgccgccatcttgtactaatttacacatgtgtgctacttttgtaaatggtgattaggaacaaatctagcaaaataatgtgaaactaaatagacacgccattcaaagggcatgcatcttctaaatgtagcaaatgtgggggcaaatgaagtatggcccaaagctcttgtgtcctttgtgattttttgttaattggctaattcttttctccaaacactttagaatcccaacttatacgagacctttgccagctagttatgtttagagaaatgttattatatattctcagcccagcccagaagcgacttactttgtaactaagcaacagcactgagatccggggcttgcgagtctcccacaaatctttccactaaccaacctaatgccgctgctaaccctgccactttaaaatgacttcttttaagacaagttaaagggtccaccataggcatagtcctctagaaacaggaatcaatgacagcagaactcctcagcttccagcagaaggaactgccacatgaatgctaactaaagctaccaaaatgtacacattcatacatatgtgtccgcagccattctcagaaattgtcatatttctaacctgtaatctttagatggttaagatcagctccatcttcggagatacactgtagaagttgtatgttacagttactacaggagaatgttattccagacatatttgctgaccagcattttgctgatttttagttaagaaatgggttattttctacccaaatgcaaattagtccaaaattaaatagagacagtattcagattagctgtatccctgagggttttagcccttttcctgggctgcctctgaatcctttctctaaccagagagccactctgagaacccattggctccagcacgacgccgtctggtcagagcctgctgcagtgcagcccagggagatgctggacccagccttgctgtctggcttcctcagacttaaagcagctcatagccaaacacgagaggctctgtgaggatggaagacagttccaaaccacacacaaagcacaagtaaagccttgcacagaaaagcctgcttgttggtttagttggatggaaatctaaagtagctattcagttttcagattttgtatcatgccatccatctccagattttaagttaccatcaagattcaaaggaagatatgagtaacaaagaaaagaaattagtagcaacggtatggtctgcggagagccagagttcaggttcagatctgggctttgcacttactagttgtgtcaccgcgggcagttactaacctctcagtgcctgttccctcgtttgcaaaatgaggatgatactagtacctatcttgtagaattgtgagcatgtgaatgagttaacatacataaagcacttagaataatgtctattatatataaaatgctctgttactgattagtcttatcatccatatcattatattaacctgtgttgtgatactggaattttccaatgagaaaaaaaaattatattgcctactatcccattttgaaagacaatt

SEQ ID NO: 65687 - DNA, 1530 bp, Homo sapiens
  misc_feature (1011)..(1011): n is a, c, g, or t
  misc_feature (1042)..(1042): n is a, c, g, or t
gatattttccaatttgtcactggatgagcgttgcctttccgcatcattggtttgcaagtactggcgtgacctttgtttagacttccagttttggaagcagctggatcttagtagtcgtcagcaggtcactgatgaattgttggaaaaaattgcatcaagaagtcagaatataattgaaatcaacatttctgattgtcgcagtatgtctgataatggcgtatgtgttttagcatttaaatgtcctggacttcttaggtatacagcctacaggtgtaaacagctttctgacacctctattattgcggttgcctctcactgtcctttacttcagaaagtgcatgtaggcaaccaggacaaactcactgatgaaggactcaagcagctgggctcaaaatgcagagaactcaaagatattcatttcggccagtgttacaagatctcagatgaaggcatgatcgtcatagctaagggctgtctgaaattacaaaggatatacatgcaggaaaacaaattagtgacagatcagtcagtgaaagcatttgctgaacactgtcctgagcttcaatatgtaggcttcatgggttgttcagtcacttctaaaggagtcattcacctaaccaagctaagaaacctttccagcttggacctacgtcatatcactgaactggataatgaaaccgtgatggaaattgtcaagaggtgcaaaaatcttagctctctcaatctctgtctgaactggatcataaatgacaggtgtgtggaggtcattgcaaaggaaggacaaaacctgaaagagctatatttggtgtcctgtaaaatcacagattatgcactgatagccattgggcgatacagcatgacaatagagactgtggatgtcggatggtgtaaagaaatcacagaccaaggagccaccctgattgcacagagcagcaagtctctgagatatttggggctgatgagatgtgataaagtcaacgaagtgacggtggaacactggtgcagcagtanccccacatcaccttcagcaccgtcctgcagnactgcaagaggaccttggagagagcctatcagatgggctggacccccaacatgtctgccgcctcctcctagcgctcctgcctcgcctagtccactgggatcattcagcagagcagaggagaattgtacatttggggagctgatctctcggaagggttttaactgtcacctgtctgtgtgtgttcaagtatgtgtattgtgtcttgttgcatactgataccaaaaagtgcagttgtcatttgttcccaagtgagctggctttttttcttagaaattaaagattatgaaagccacaaactttttagtttttaacttcaaaggcttctttctctttaaaaaaagaattattttgtaatatagagtcaaaaaatggggctgtattatttggagcttctaaatggctggcacttggggatggcccaggtaagaagggcctctttttaccttgggctggaatgggtgccttctaatgatgatggaacacacggg

SEQ ID NO: 65688 - DNA, 356 bp, Homo sapiens
  misc_feature (307)..(307): n is a, c, g, or t
tcaataaatatcagttatcttcccctttccttgatcttagattacaaaaatatcagcaacatcctccagatatggacatgttgaaaaccaacaaaaaatcatagcttcttccaaaattacagaaatttatattaactaaccaacactggtttactccacaaaattcaacatacacattctaatgcatctatgtgtctgtaagtgcactgcattgaggccctactaaacacaaacttcactttatccattgctgtgtgtggacttcacccaggagagtttctccttggacattttcgtcacctaacgncaacgactgaggatcttggagggctcagaagacaggaaggatgtggtaa

SEQ ID NO: 65689 - DNA, 274 bp, Homo sapiens
cctctctgtggaggtgatgttttagtacagacccgcgtgaagtgaggaatctagccataaagatggggatgaagaagagtagtccagacagacggaactgaaaattgtaaagagcctgaggtgcaattccttgttctgttctaggaatagcacaaaggccggcatagatggaatgcactgagcaaggggaatgtgacaagagttgatgctaaggaagcagcctgggctaaatcatgcgtggacttgcagaccaaggtgaggactttggtttatc

SEQ ID NO: 65690 - DNA, 1669 bp, Homo sapiens
  misc_feature (1276)..(1276): n is a, c, g, or t
cggcgctcggagcccgacgcctcgcgagggcgcccgcggagcctccccggccctgggcgttgggcgagccccggggcggtcggaggggcccgggggcggtcggagaagcccggacgccggctgcgcgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggtaagagaagctttctagtccataagttcagttctcttttctgattgttacttgagtggttagttaagtagtgcttgagaaaaaggactctggttcaaatccaggttccattttgctatctttgtgaccttgcacaagttgtttaacctctttgttcagaaatttctccatggagtaacaatatctaggttgggaggattagtgaagttacatgtaaagcacagaggaacagccaagagatnttaccgtggtcttactaaagtacatatcctaacttggggtttaccttcagcaagttagactggccgtgcatggtgctcacgcctgtaatcccagcacctcgggaggccgaggcgtaaggactgcctgagcccagaagttctagaccagtctgggaaacgtggaaagacccccgtctcaaaaagaaaacagaaaaaaaaaagtttgtgtatttatttctgtgacagtgaacacatttaagatgcagtgtagtttctgaaagaaattgagggcttatataaaaaggaaaactcagtgattaaccttgcacatgcccacttaacaaaagcctcaaactttaaaacatttgacttatagcattgagttcctaaatggaacaacttgtctttgtccac

SEQ ID NO: 65691 - DNA, 663 bp, Homo sapiens
tcgttagaggatcctctgctgcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttca

SEQ ID NO: 65692 - DNA, 3453 bp, Homo sapiens
cggcgctcggagcccgacgcctcgcgagggcgcccgcggagcctccccggccctgggcgttgggcgagccccggggcggtcggaggggcccgggggcggtcggagaagcccggacgccggctgcgcgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggccttgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttca

SEQ ID NO: 65693 - DNA, 3577 bp, Homo sapiens
gcagcgtcctgtgttggaatgtgcggctgccgcgagctcgcggcgcagcagcggagcgagcgccgccgaggcccggggccccagaccctggcggcggctgcggcagccgagacggcagggcgaggcccggaggcctgagcaccctctgcagccccactcctgggccttcttggtccacgacggccccagcacccaactttaccaccctcccccacctctcccccgaaactccagcaacaaagaaaagtagtcggagaaggagcggcgactcagggtcgcccgcccctcctcaccgaggaaggccgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggccttgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttca

SEQ ID NO: 65694 - DNA, 3366 bp, Homo sapiens
tttaaataccttacccattcatatctctatcacgtggccgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggccttgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttca

SEQ ID NO: 65695 - DNA, 3631 bp, Homo sapiens
gcagcgtcctgtgttggaatgtgcggctgccgcgagctcgcggcgcagcagcggagcgagcgccgccgaggcccggggccccagaccctggcggcggctgcggcagccgagacggcagggcgaggcccggaggcctgagcaccctctgcagccccactcctgggccttcttggtccacgacggccccagcacccaactttaccaccctcccccacctctcccccgaaactccagcaacaaagaaaagtagtcggagaaggagcggcgactcagggtcgcccgcccctcctcaccgaggaaggccgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggccttgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttca

SEQ ID NO: 65696 - DNA, 3503 bp, Homo sapiens
cggcgctcggagcccgacgcctcgcgagggcgcccgcggagcctccccggccctgggcgttgggcgagccccggggcggtcggaggggcccgggggcggtcggagaagcccggacgccggctgcgcgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcagtggggtatggataccatttggtaatatttactagagtgtgatctagatgggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggccttgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttca

SEQ ID NO: 65697 - DNA, 1734 bp, Homo sapiens
cgaagagaacgacagtgacacctggctacagccctatgagcccgcggaccccgccctggactggtggtgaggcgccctcgtggccgcgggactggccccgggggggccccctggatcccaggccagcgctttgctctcctgctccgtctgaagggagcaggtgcaccagccaaaatgtcagcgagggggacaaagagagggacctttgcctacgtagatgtgtatgtgtagtgcgattttcttcaaggaaaggagacaagtccaaagctcgtttgtggattgtgggactgagcgaaggagtacaaatatatccacgtcgctcagagctggggtgctcacggtgggcggtgggcaagaagccagcatggaagaaagaagggagaaaactttggtgactgccttagagggatcagttaatttgtatagttttatattttttgtatatgtttgctagctctaaaaaggtcgagatgcaataacacttcgtaagcaacgagttcacctaagtaaggctcagatcctagttttaaaaaccatttcccattaaaatgaagttggaggaacagctgcttctggagccggggcaaaaatttcaaggtgagcctggagcattgtgtgtggtgaagtaaaataaaggctcaaaacgtgacggcaacccggcaaaagggtagggagccaggccgaaggggcctcactgaccaattgtgggacaatttgaacatcaggatgaataatgacaggagagattataacacactgaataaaaacataatccatgagttcatgctgatactcaaatttctttttaaaaaggagaaacaggaaggtttcttttggaggtgaaatctaattattggtgagagtcttggagaacaggctgtttccagtctcaaagcagtaaccttatacactacttataagtttgaaaggggaaaggttacctttacaatggagacatctaccagatcatccaagtgattaaatttaacatcatcaatgatgggaccaaggacattattagtttgacaactggggaaagaagtgttcttcaccccctacccccaagacattctctctgtcggccaggctggagtgcagcctcaacctcctgggcccaagtgatcctcccacctcagcacacaacaccatgccagcaattttaagtgcgttatagagacgggggtctcactttgttacccaggctggtctcaaactcctgcgctcaagcaatcctcccacctgggcctcccaaaatgctgggtgtacaggcatgagccgctgtgcccggcttcattttcagagtgagacatttgtactgtggctatgtaggagaacattcttgttcttagcaaacatactgaagtttttagatattaattaccacagtgtctgccactgaatttccagtgactaagtggaaaaatataaaacatatgaatataaagaaagaaagagacaagtcaaatgtagcaaaatgacaacacttggtgactctaggtgactggtcgacagatgttcattgtactatcaatgtggctttgctgtgggtttgaaattttgcaaactaagagttgggtggcggggagaaggatacaccaaaaaactaagtgattatctttggatgggaaaatgtttggtaattgcattcttaaaatgtcttctttgtattttttaatgttcaataatgtatatgtatcagttctgtaataaaggggaaaacactttttttaaata

SEQ ID NO: 65698 - DNA, 1590 bp, Homo sapiens
atccgcctcaccattgctgaagagagagacaaaagactggcggggacaaagagagggacctttgcctacgtagatgtgtatgtgtagtgcgattttcttcaaggaaaggagacaagtccaaagctcgtttgtggattgtgggactgagcgaaggagtacaaatatatccacgtcgctcagagctggggtgctcacggtgggcggtgggcaagaagccagcatggaagaaagaagggagaaaactttggtgactgccttagagggatcagttaatttgtatagttttatattttttgtatatgtttgctagctctaaaaaggtcgagatgcaataacacttcgtaagcaacgagttcacctaagtaaggctcagatcctagttttaaaaaccatttcccattaaaatgaagttggaggaacagctgcttctggagccggggcaaaaatttcaaggtgagcctggagcattgtgtgtggtgaagtaaaataaaggctcaaaacgtgacggcaacccggcaaaagggtagggagccaggccgaaggggcctcactgaccaattgtgggacaatttgaacatcaggatgaataatgacaggagagattataacacactgaataaaaacataatccatgagttcatgctgatactcaaatttctttttaaaaaggagaaacaggaaggtttcttttggaggtgaaatctaattattggtgagagtcttggagaacaggctgtttccagtctcaaagcagtaaccttatacactacttataagtttgaaaggggaaaggttacctttacaatggagacatctaccagatcatccaagtgattaaatttaacatcatcaatgatgggaccaaggacattattagtttgacaactggggaaagaagtgttcttcaccccctacccccaagacattctctctgtcggccaggctggagtgcagcctcaacctcctgggcccaagtgatcctcccacctcagcacacaacaccatgccagcaattttaagtgcgttatagagacgggggtctcactttgttacccaggctggtctcaaactcctgcgctcaagcaatcctcccacctgggcctcccaaaatgctgggtgtacaggcatgagccgctgtgcccggcttcattttcagagtgagacatttgtactgtggctatgtaggagaacattcttgttcttagcaaacatactgaagtttttagatattaattaccacagtgtctgccactgaatttccagtgactaagtggaaaaatataaaacatatgaatataaagaaagaaagagacaagtcaaatgtagcaaaatgacaacacttggtgactctaggtgactggtcgacagatgttcattgtactatcaatgtggctttgctgtgggtttgaaattttgcaaactaagagttgggtggcggggagaaggatacaccaaaaaactaagtgattatctttggatgggaaaatgtttggtaattgcattcttaaaatgtcttctttgtattttttaatgttcaataatgtatatgtatcagttctgtaataaaggggaaaacactttttttaaata

SEQ ID NO: 65699 - DNA, 2052 bp, Homo sapiens
cgaagagaacgacagtgacacctggctacagccctatgagcccgcggaccccgccctggactggtggtgaggcgccctcgtggccgcgggactggccccgggggggccccctggatcccaggccagcgctttgctctcctgctccgtctgaagggagcaggtgcaccagccaaaatgtcagcgagggggacaaagagagggacctttgcctacgtagatgtgtatgtgtagtgcgattttcttcaaggaaaggagacaagtccaaagctcgtttgtggattgtgggactgagcgaaggagtacaaatatatccacgtcgctcagagctggggtgctcacggtgggcggtgggcaagaagccagcatggaagaaagaagggagaaaactttggtgactgccttagagggatcagttaatttgtatagttttatattttttgtatatgtttgctagctctaaaaaggtcgagatgcaataacacttcgtaagcaacgagttcacctaagtaaggctcagatcctagttttaaaaaccatttcccattaaaatgaagttggaggaacagctgcttctggagccggggcaaaaatttcaaggtgagcctggagcattgtgtgtggtgaagtaaaataaaggctcaaaacgtgacggcaacccggcaaaagggtagggagccaggccgaaggggcctcactgaccaattgtgggacaatttgaacatcaggatgaataatgacaggagagattataacacactgaataaaaacataatccatgagttcatgctgatactcaaatttctttttaaaaaggagaaacaggaaggtttcttttggaggtgaaatctaattattggtgagagtcttggagaacaggctgtttccagtctcaaagcagtaaccttatacactacttataagtttgaaaggggaaaggttacctttacaatggagacatctaccagatcatccaagtgattaaatttaacatcatcaatgatgggaccaaggacattattagtttgacaactggggaaagaagtgttcttcaccccctacccccaagacattctctctgtcggccaggctggagtgcagcctcaacctcctgggcccaagtgatcctcccacctcagcacacaacaccatgccagcaattttaagtgcgttatagagacgggggtctcactttgttacccaggctggtctcaaactcctgcgctcaagcaatcctcccacctgggcctcccaaaatgctgggtgtacaggcatgagccgctgtgcccggcttcattttcagagtgagacatttgtactgtggctatgtaggagaacattcttgttcttagcaaacatactgaagtttttagatattaattaccacagtgtctgccactgaatttccagtgactaagtggaaaaatataaaacatatgaatataaagaaagaaagagacaagtcaaatgtagcaaaatgacaacacttggtgactctaggtgactggtcgacagatgttcattgtactatcaatgtggctttgctgtgggtttgaaattttgcaaactaagagttgggtggcggggagaaggatacaccaaaaaactaagtgattatctttggatgggaaaatgtttggtaattgcattcttaaaatgtcttctttgtattttttaatgttcaataatgtatatgtatcagttctgtaataaaggggaaaacactttttttaaataaaaaaaaaaaaaaaaaaaaaaaaaaaaaaaaaggaggggggctcgtgccgaattcggcacgagaggcgacaaacctaccgagcctggtgatagctggttgtccaagatagaatcttaggtcaactttaaatttgcccacagaaccctctaaattcccttgtaaatttaactgttagtccaaagaggaacagctctttggacactaggaaaaaaccttgtagagagagttaaaaatttaacacccataggtggcctaaaagcagccaccaattaagaaagcgttaaaggtaacacccactacctatacctattgaagaa

SEQ ID NO: 65700 - DNA, 348 bp, Homo sapiens
tgatttcagactgccttactttgctggctgatttgcaaagcaaagtataaactttattatgtttcagaaaacatgctcagagaagttataggccaaagtgaagaagctgggactcaaaattcagcagtcttccagggaaattgtctctcagaatttagttattacagagttttatgataatgaagtatcataaaagtatattaacaatagcagatataatttctaccaagaagagattattttttatataagatgcaagtatgtgtcttctgtcagagtagaccagattcatcagagggatcatcatatctttccttcataatccaaagaaatattatgctataaatg

SEQ ID NO: 65701 - DNA, 396 bp, Homo sapiens
ttttatcatggaatacaagcttttatacagcacttttattgtacattcctgattaatgaaaaggattttggaaatacattaactttaggccaaaatagtgtccatttattcttaaattgtcaatggtacaaaaaagaaaaaagcaaggatacttgaggggaaagggcagagaatctatatactgaaactaatttttaaaaaaatgtctttgatatttaaaagcaatagaaaaagaagcacaattctcagataatagtataaaataaaaaataaggaaaattaagcattgataaacaccaaattcccaagtgataggatttttaagatgtaaagaatgagtgataatatactacattgattaagctgctacagaataccatgacactatgcacagat

SEQ ID NO: 65702 - DNA, 372 bp, Homo sapiens
ttcaccagtttttaaactgagacaagataaaatctgtttggattaggtgttttgttcaggggaatgcagaatgtatcctttactcttaacttgaagatgatcaagatataatccttttagccagggtggcaatttaaacataaaaatctctgttttccagttgatgagtgaatcttcctagaagggcacacaacttttcccctttccatgatggggtttaaaggccatgtttacatctgccaagtctctgggtaaacatttagctgctgtcccaacaggcagtaccagcatcttactctttcttctcataggtagaactagtaacacaatgtgcagagctttttggataaggtaggagaaaatagtcaggtt

SEQ ID NO: 65703 - DNA, 2488 bp, Homo sapiens
  misc_feature (383)..(383): n is a, c, g, or t
cagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgcnctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctggaatttaaattcaagcatgttttaacttttggtttaaggtacttgggtgtacctggcagtgttgtaagctctttacattaattaattaactctctaggtactgttatcttcattttataaacaaggcagctgaagttgagagaaataagtaacctgtcctaggtcacacaattaggaaatgacagatctggcagtctatttccaggcagtctatttccacgaggtcatgagtgcgaaagagggactaggggaagaatgattaactccagggagctgacttttctagtgtgcttacctgttttgcatctctcaaggatgtgccatgaagctgtagccaggtggaattgtaccacagccctgacatgaacacctgatggcagctgctgggttggagcctagacaaaaacatgaagaaccatggctgctgcctgagcccatcgtgctgtaattatagaaaaccttctaagggaagaatatgctgatatttttcagataagtaccccttttataaaaatcctccaagttagccctcgattttccatgtaaggaaacagaggctttgagataatgtctgtctcctaagggacaaagccaggacttgatcctgtcttaaaaatgcaaaatgtagtacttcttccatcaaaggtagacatgcactaagggacaggttttggcttggtatcagaatacatttttaaaagctgtgtaagaattgaacgggctgtactagggggtata

SEQ ID NO: 65704 - DNA, 2433 bp, Homo sapiens
cagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataagggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctggaatttaaattcaagcatgttttaacttttggtttaaggtacttgggtgtacctggcagtgttgtaagctctttacattaattaattaactctctaggtactgttatcttcattttataaacaaggcagctgaagttgagagaaataagtaacctgtcctaggtcacacaattaggaaatgacagatctggcagtctatttccaggcagtctatttccacgaggtcatgagtgcgaaagagggactaggggaagaatgattaactccagggagctgacttttctagtgtgcttacctgttttgcatctctcaaggatgtgccatgaagctgtagccaggtggaattgtaccacagccctgacatgaacacctgatggcagctgctgggttggagcctagacaaaaacatgaagaaccatggctgctgcctgagcccatcgtgctgtaattatagaaaaccttctaagggaagaatatgctgatatttttcagataagtaccccttttataaaaatcctccaagttagccctcgattttccatgtaaggaaacagaggctttgagataatgtctgtctcctaagggacaaagccaggacttgatcctgtcttaaaaatgcaaaatgtagtacttcttccatcaaaggtagacatgcactaagggacaggttttggcttggtatcagaatacatttttaaaagctgtgtaagaattgaacgggctgtactagggggtata

SEQ ID NO: 65705 - DNA, 1981 bp, Homo sapiens
  misc_feature (383)..(383): n is a, c, g, or t
cagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgcnctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttatgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagcgccaactctcctagacctggtgcctgttttttttccaagttttgtttctacttctatccattttttaaattaaactttttattttgaaataattatcacactcacaagctgtgggaagaaataatagagatcctgtgtctctttcatccagttttcctcaagggtaacatcttacaaaactatagtacaatagtggaatagaatattggtgtt

SEQ ID NO: 65706 - DNA, 2049 bp, Homo sapiens
  misc_feature (383)..(383): n is a, c, g, or t
cagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgcnctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggtaagtagcttatgtttattttacattggcagccttccttgtgatcaaaaaaggtaatcccagaaacgtacccgttcactcgtgggtcttaaaatggtttcatatctctattgtgactaattttctctcggtctactgccttttcaatcaggaatagatttgccatgaagccagtgaagtttttaagtgtctaggcttctcattagcgccaactctcctagacctggtgcctgttttttttccaagttttgtttctacttctatccattttttaaattaaactttttattttgaaataattatcacactcacaagctgtgggaagaaataatagagatcctgtgtctctttcatccagttttcctcaagggtaacatcttacaaaactatagtacaatagtggaatagaatattggtgtt

SEQ ID NO: 65707 - DNA, 2574 bp, Homo sapiens
  misc_feature (383)..(383): n is a, c, g, or t
cagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgcnctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctcacccccctacattctagaatgatctttttctaggtagattgtgtatgtgtgtgtatgagagagagagagagagagagagagagagaaattatctcaagctccagaggcctgatccaggatacatcatttgaaaccaactaatttaaaagcataatagagctaatatat

SEQ ID NO: 65708 - DNA, 2506 bp, Homo sapiens
  misc_feature (383)..(383): n is a, c, g, or t
cagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgcnctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctcacccccctacattctagaatgatctttttctaggtagattgtgtatgtgtgtgtatgagagagagagagagagagagagagagagaaattatctcaagctccagaggcctgatccaggatacatcatttgaaaccaactaatttaaaagcataatagagctaatatat

SEQ ID NO: 65709 - DNA, 1713 bp, Homo sapiens
  misc_feature (383)..(383): n is a, c, g, or t
cagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgcnctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggctacagattgttttagattgaagtttcctgtcatgttcactcatctttaaatcctcatagtaaaaaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtggggttctcaagataaaggagataacatccagctttcctgccccacaccgtatctgaaataaaaacaacagcagggatagcagatt

SEQ ID NO: 65710 - DNA, 2563 bp, Homo sapiens
  misc_feature (383)..(383): n is a, c, g, or t
  misc_feature (1776)..(1776): n is a, c, g, or t
cagaaatgcaacgctttagagtacccacggaaaacttgtttaccttgtcaccatgagtaaaagttaattcccactcctgaagagagcaaaccaactctgaaagagagtgaaaatgcagacaagacagttatcagataatggctatctggacgagagattctttcgtttgacagcagtttggttgttgggagttccagttcagctcctgcacagttgctctgtacaaatcctcctccatatttgcttagagaaaacgtgttgccatcccatcatgaaggaagctgcctgagagtttttaaccattacagccgtgatgatgaaagagtgaagaaccgcctctaagttaaaaagtgcacccagagataaggttcgttctcaatgcnctgccgctgcttctcatcgcatggccaccgcatttctcaggccaggcacattgagcattggtcctgtgcctgacgctatgctagatgctggggttgcagccacgagcatagacacgacagacacggtcctcgccatcttctgttgagtactggtcggaacaagaggatcgtctgtagacaggatatgatcatcgtggcgcatgtattactcatccttttgggggccactgagatactgcaagctgacttacttcctgatgaaaagatttcacttctcccacctgtcaatttcaccattaaagttactggtttggctcaagttcttttacaatggaaaccaaatcctgatcaagagcaaaggaatgttaatctagaatatcaagtgaaaataaacgctccaaaagaagatgactatgaaaccagaatcactgaaagcaaatgtgtaaccatcctccacaaaggcttttcagcaagtgtgcggaccatcctgcagaacgaccactcactactggccagcagctgggcttctgctgaacttcatgccccaccagggtctcctggaacctcaattgtgaatttaacttgcaccacaaacactacagaagacaattattcacgtttaaggtcataccaagtttcccttcactgcacctggcttgttggcacagatgcccctgaggacacgcagtattttctctactataggtatggctcttggactgaagaatgccaagaatacagcaaagacacactggggagaaatatcgcatgctggtttcccaggacttttatcctcagcaaagggcgtgactggcttgcggtgcttgttaacggctccagcaagcactctgctatcaggccctttgatcagctgtttgcccttcacgccattgatcaaataaatcctccactgaatgtcacagcagagattgaaggaactcgtctctctatccaatgggagaaaccagtgtctgcttttccaatccattgctttgattatgaagtaaaaatacacaatacaaggaatggatatttgcagatagaaaaattgatgaccaatgcattcatctcaataattgatgatctttctaagtacgatgttcaagtgagagcagcagtgagctccatgtgcagagaggcagggctctggagtgagtggagccaacctatttatgtgggaaatgatgaacacaagcccttgagagagtggtttgtcattgtgattatggcaaccatctgcttcatcttgttaattctctcgcttatctgtaaaatatgtcatttatggatcaagttgtttccaccaattccagcaccaaaaagtaatatcaaagatctctttgtaaccactaactatgaggtcctctgcattttcatatacatcttagattcngctgacaattttctacaaaaaaagaaagctgggtccagtgagacggaaattgaagtcatctgttatatagagaagcctggagttgagaccctggaggattctgtgttttgactgtcactttggcatcctctgatgaactcacacatgcctcagtgcctcagtgaaaagaacagggatgctggctcttggctaagaggtgttcagaatttaggcaacactcaatttacctgcgaagcaatacacccagacacaccagtcttgtatctcttaaaagtatggatgcttcatccaaatcgcctcacctacagcagggaagttgactcatccaagcattttgccatgttttttctccccatgccgtacagggtagcacctcctcacctgccaatctttgcaatttgcttgactcacctcagacttttcattcacaacagacagcttttaaggctaacgtccagctgtatttacttctggctgtgcccgtttggctgtttaagctgccaattgtagcactcagctaccatctgaggaagaaagcattttgcatcagcctggagtgaaccatgaacttggattcaagactgtcttttctatagcaagtgagagccacaaattcctcacccccctacattctagaatgatctttttctaggtagattgtgtatgtgtgtgtatgagagagagagagagagagagagagagagaaattatctcaagctccagaggcctgatccaggatacatcatttgaaaccaactaatttaaaagcataatagagctaatatat

SEQ ID NO: 65711 - DNA, 253 bp, Homo sapiens
taaaaacaaagatagtaagtcctcaaaactcttcactttgtaattattgtattcatgttagtcttgtccaccatcgaggttgttggcagcgactgtgttgcatggtgaggatgctgtgtaatggtgtgctaccataactgaccccaggtgtgtctgctcactgcttgaaagccagattcgagagacaagtgttggtgggaggaaaagcaggattaattggaaagccaggaaaccgagaagatggggaactagc

SEQ ID NO: 65712 - DNA, 507 bp, Homo sapiens
atctttccaattttaatttaatatgactgattaaaaaatcattcatcatgttattatgaaagtgtttaccttatctcaagtatttatcagcagacttttggcattagttttcaaaaacaagatatattaatagacatgtactttgaatttttctaaaataattttatcccaacattttgggcaagaatagtgttaggtaaaagtgataggtgaattaatattgccactgcttttgagtgtgtagctattacatattttggctgtcttttaagatgtatttgggtgcctagaacatgcaaatttcatttaaattggtgtttgaacttaatgattcagagctttagctgagtattaatttatgtctgatcagtagtttgaaagacagtgacttatcagatgtgactaaataaatatacatgcttataatgatactgtacagttcatgtagttgattttttttctaatataaacatacttaaaaaacactgttatggatggaaatcagtt

SEQ ID NO: 65713 - DNA, 401 bp, Homo sapiens
attttagcagctttcttgaaatttaaaatatatgtgtaagtatctcatttatatgcatttctagtttctttatacaacagaataacttcttttacatcaaatttctgaatttgactaaatttagaaataatggaatctcatccattaaatatagtcatagaaggaaggaaatatgaaaattaggatttcagatgtttgaacataaaagataattttaaacattgtcagtaatctatttctttttttttttcgagacggagttttgctctgtcacccaggctggagtgcagtggcacgatcttggcttactgcaccctctgcctcccagttcaagtgattctcctgcctcaacctcctgagtagctgggattacaggggcatgccaacatgccgggctaatt

SEQ ID NO: 65714 - DNA, 406 bp, Homo sapiens
cccaagtaataatcaaaagactttaaaggcaatacaggaggttacatagatgtaaaacattaattcttttaaatatcagttttttaaggaattaaaaacctaataaagagtataggaattattttgataaaacctaaaatgttgtctcttaagcgagttatcagaaaggcaaagaaaaacctgcaatgtgactgcttcttatgggaagcccatttacataacctgaaaattaaatctgatgaaaaagtacttgaatttaatcagacatcagaagattgtgttaagattatgagtatagcaggggaatatataattcttagtaactgcataagaagttttctgattacattcaaaaatttagacatatcaagaaaagccaagatgacaaaatcaggttatactggag

SEQ ID NO: 65715 - DNA, 2115 bp, Homo sapiens
  misc_feature (1189)..(1189): n is a, c, g, or t
  misc_feature (1226)..(1226): n is a, c, g, or t
  misc_feature (1689)..(1689): n is a, c, g, or t
  misc_feature (1862)..(1863): n is a, c, g, or t
  misc_feature (1934)..(1934): n is a, c, g, or t
  misc_feature (1953)..(1953): n is a, c, g, or t
  misc_feature (1956)..(1956): n is a, c, g, or t
  misc_feature (1959)..(1959): n is a, c, g, or t
  misc_feature (1997)..(1997): n is a, c, g, or t
  misc_feature (2003)..(2003): n is a, c, g, or t
  misc_feature (2043)..(2043): n is a, c, g, or t
  misc_feature (2050)..(2050): n is a, c, g, or t
tgggtctcgatgacttgtcgaaggctgagctgattgcttctcctgcaacaattatcctggagcttcagacaacatcagaggaaataaatagttggaaagtttagagacagggactggaggaaaaagtcagggaggacatttaagaaacggggtgagcgggaagatgtcctgagcactcgctgggaggaaaggtagagaggaggagccccttcccatcctaagctctcatggttcttaggaagcatccatgattgttggaatctgaagcgatgcaggagacagcaaatttgctgctttttagaattaatggggatcttctggaatttcctagccccatgttcttattttatagatgaagacactgaggcctagatgggggaaggggttgtctttgcagagtggtggcgaagacaggattgaagtcagatctctgtcatctctaaaatggatttaagggcatgagagttcagatgtcttttcaagatcttgatttcaattctttctttttttttcttttgagagacttggtctcactctgtcacccaggctggtcttgaactcctggtctcaagtgatcctgctgcctcagcctcccaaaatgctgggattacaggcatgagccacctgcctgacctgatttcaattctttggatgaatacccagaagtgagactgctggatcatatggtagttctatatttaattttttgaagaatctccatactgttttccatggcaggggacatcattttatattcccaccaacaatgtacaaaagttccctttttcttcataccctcactgacacttggtgccttttgtgtttttgataataaccatcctgacagatgtgaggcaatatctcattgaagttttgatttgcacttccctgataattagtaaaattgactaccttgtcacatgtgttggccatttatttgtcttctttgaagaaatgtctattcaactctttagcccattaaaaattaatatgtaattgttgtacatatttttggagtactggtgatatttcgatacctgtatataatgtgtaagaatgagatcaggatacttgacatatctatcacctcaaatgtttatttttcttgtgttgggaacattacaaatgtagctattttgcatatacaataagttggattttggggattctttggctattgagttgtagnaattccttatatattctagaaattaacgccttatganatatattgtttgcaaatgttttccttcattgcatagtttgccctttcactctgttgattgcttccttttctgtgcagacactttttagtctgatgtagtcacatttgcctatttttgcttttgttgcctgtgtttttggtgtcctatccctgaagtaattgcaaagaccaatgatatgaagcttctcttgtgttttcttctaggggttttaggagtttcaggtcttaggtttcagtgtttaatccattttgggttgattttggggtatggcggaagagaagttccaatttgtaacttttgcatatagatatctgttttttccaacaccatttgtgaaagagaatgtcttctccccagtgtgtattcttggcagcagtactatttataataaccaagatgttgtagaaacaacccaaatgtccatctatgaatgactagataaagacaatgtggcatataaatncaatgaaaaactatttagctttaaaaaagaaggaaatcctgtcatatgtgacaacatgaatgaacattgaggacattatgccaagtgaaacaagccaggcacagaaggacaaatactgcgtgattccacttatatgagttagataggtccaggcaaggtggctcatgcctgcnntcccagaactttgagaggctgaggagggagggtcacttgaggtcaggagtttgagaccagcctggtcaacntggtgaacccccgtctctnctnaanatacaaaaattagccaggcatggtggtgcaggcctgtngtctcngctacttgggaggctgaggcgggagaattgcttgaacccnggaggcngaggttgcagtgagccgagattgcatcactgcattccagtctggtgacagagtgagactccatct

SEQ ID NO: 65716 - DNA, 778 bp, Homo sapiens
gaccaaaacacaatcctttttaaaaaatttgtttacaatttcagtatgttatgtagttacagatgagtaagtcagagaattaatttcacaatgaagtaattaacactttcaaaggactgtactttaaaatttcaaagtgtgatgttttctattggtgtagaatgagcctaaataaggagtaaaaagacacgagccctactccttgatctgccaatgacagatgactttgggccaccatgttatctctctgagcctcagtttccttatggtgagaacacagtagtctcccccttattttcaggggatgcattccaagaccccctgtggatgcttcaaaccatggttagtatcaaaccctatatatactgtttttttgatctgataaccaagcctgctactaagtgacttgtgggtgggtagcatctacagtgtagataggctggacatagggatgattcatgtcccaggctggacagtgagatggcaggacagtacaagatttcaccacaaagaatgtcattataactaaaatagataaggtatgtgaacatgcttcataagctgaaaagcgccacacaaatgccaggttttgttctagtggccttgtctaatgtgtcgagacacaatctatactgccctccgaggtggtgttgaaacagtggaaatgcaacgagatctgctttgtttcccaaactggatttggttagattggaaaataaactaaacatgcttgagcagaggctttgaaaagaataaatattaaattatggaaatgcct

SEQ ID NO: 65717 - DNA, 360 bp, Homo sapiens
aattctatcagacagcattacagtggtttcccattgggccccaagtgatctgggcccttcatccactccccacccctaatctctccaacctcatctcttttccctctgccctcactcattcagctccaatttcactggcttcctggctagttctttaatgggccaagtatcatcctgtattcaggtcctttgcagctgctcatctctctcctggagtcatcttccccctgatatctccatgtcttgctgtcaggtctctgctcaaatgtcaggttattagacagactctgcgaccaccctagttaaaacagcagcccatcaaagtctttaaccctcttagcatttactcagattactttt

SEQ ID NO: 65718 - DNA, 318 bp, Homo sapiens
agtgtctgctgagggcttcttccatcttctctcagcagcatccccacatggcagaaggtggaaggacaaaagggtttatgctagccctccagcccttttataaggcactaatccattcacaagggcagagcccttatgacttaatcactccccaaaggcctcacctcttaataccaccacaatgtggatggattttggaagccactcatgcaaatcataccaccatccaaccatctattgaataagccttctttcccctactgatatgttattttcataaaatattatattcttatgaaaactaaagtgtatttctag

SEQ ID NO: 65719 - DNA, 401 bp, Homo sapiens
atctggacctcgagcctcatctgtaatttcaacgtctgctttctctatttctgatacatggagattaagtgcctttactatgaaaaaactgacggcttctgctttaaccaggctgcagcctgtacaagcccgtcctacttgccagcatgtcactggagtcacacccatagaaggctgtaacccatgagacttagcttcaaatgaaatctgacagatggatgttactcacaaagctgtcattggcaagctcgcctttgttcatgggactatagacacttattctcacatgcggcatgctacatgtaaaccaggtcaaacagctggttatttacaatgacattgtctgtcatcatgtgctcatatgggggttcctaggcaattaaaaactgacaatggacacg

SEQ ID NO: 65720 - DNA, 2214 bp, Homo sapiens
actgagggtggtggagcaggtagatggaaagaactctcttcccaaagacaagccgcagagccgcatcccttccccagcccctgtgttaggccgtgaggcatcttcctgccagcctgcaccagggctttcaggttttgttgcttagcacatccagggtcatgcacttcaggacaagccacctgatgcccctcggccccccagtcctgcagcctcgctggagctctccctgcagcaggaagggctgaggccaaccacaaaggggcttggggcgacatcaagggatggcagagcgagagggaagtgcagggagcctggcccagaagaccagccctgccgccgcctcctggaaggggcacacctcctgagctaagcccaggatgccgcccaagcctcggggcctcccaaggtgtcccccatgccagagtgtgtggcctctgccaggcccagggtggctccaggtggttggactcccatttcctctccccttcccaggtctttcccaagcccagagcccctgttttagttttccagtgtggggagacaggagagtggccacagagcctggttctgcgcttggtgctgctggactccaaacctggctctggagctgcagtcctggtgagggcggtggccctggggaagatgagctccccaacacttgttacggcagtttccagtcacaagccgcaaggacacagtctcaaaggagcatcagatggggttgggggcatgtggggtggccctggctctcccaggtggggtcctgccaggccaagagctatgctaagtggggcccaccatggccataggcccctccgtgtcacctggcataatcagctggtagaaacagcccttggggactacatcacctgacctgatctccaggttccaggtaccatttcttactgccccccagcagcactgtgcccctgtccacaggtcatgtgactgggtgtcgggcacggttcccttgcagcaatgaacagtacatctgtggatgaaggtgggcagatagagggttggcggggggtggagcggggcactgatcatggcagcctgctgtggccagccccaagggcttcccggtgacttctcagagcctgaatgtctcccctggacaggtgggatcgagggaatgccatgaaggtgggcatgagggggaatctcgccaggggtacagtgcgtctacactgcttttcagactagtgccacgcaggcactaggtctcactggctgaggggcagcctctgtccccaggcgccgcgacttgccccatctgctgcagaggaggcccacctgtggtgagcattgtggtcttggggcctgcaggcgcccttgtggagttaccatggtgaccgcagccccttggactggtgctggggattcagacaccaggtcacgtaggccttggctcgtggcatggccaagccctggggtctgtcggggttggcagggcaggcttcctggaggaggggctgaggccgcgtattctccctctcatcctgccatccgctgcggctactcttcagggccacaactgtcacagaacgaggaacccgggccttgtgcagaagagccttgtgtaggtggattgagaagagagtcccagaggagaagctgagccctctgctgacttgcccccagctcatttctgcttgacctttccttgttgccgtttttgcttggaaactatattgtggacctcatcattctgggaaaaggtggttcacgagaaagcacagtcatgtgtcaattaacagtgcagatgcattctgagaaatgcgttgttaggtgatttcatcatcctgcaacatcagagtgtgccccgcgctcatggatgagacagcctgccccacacccaggctgtgggggacgggatggcctgttgcttctggaccagacgcctgcacagcacattaactgtgctgaatgctgtaggcagttgtaacgcaacgaccctgtattcagtggatcagctggcaccacccaaatagataaattggcccatctggtcttgtggcccccacccaggaatggactcagctcaagaggacagcttcagctccctaagattttatcttggacccgaccaatcagcactcccgacttactggccctctactcaccaagttatccttaaaaacctcaatccctgagttttcagagagactgatttgaataataataaaactccggtcttccacacggccaaaa

SEQ ID NO: 65721 - DNA, 3885 bp, Homo sapiens
actgagggtggtggagcaggtagatggaaagaactctcttcccaaagacaagccgcagagccgcatcccttccccagcccctgtgttaggccgtgaggcatcttcctgccagcctgcaccagggctttcaggttttgttgcttagcacatccagggtcatgcacttcaggacaagccacctgatgcccctcggccccccagtcctgcagcctcgctggagctctccctgcagcaggaagggctgaggccaaccacaaaggggcttggggcgacatcaagggatggcagagcgagagggaagtgcagggagcctggcccagaagaccagccctgccgccgcctcctggaaggggcacacctcctgagctaagcccaggatgccgcccaagcctcggggcctcccaaggtgtcccccatgccagagtgtgtggcctctgccaggcccagggtggctccaggtggttggactcccatttcctctccccttcccaggtctttcccaagcccagagcccctgttttagttttccagtgtggggagacaggagagtggccacagagcctggttctgcgcttggtgctgctggactccaaacctggctctggagctgcagtcctggtgagggcggtggccctggggaagatgagctccccaacacttgttacggcagtttccagtcacaagccgcaaggacacagtctcaaaggagcatcagatggggttgggggcatgtggggtggccctggctctcccaggtggggtcctgccaggccaagagctatgctaagtggggcccaccatggccataggcccctccgtgtcacctggcataatcagctggtagaaacagcccttggggactacatcacctgacctgatctccaggttccaggtaccatttcttactgccccccagcagcactgtgcccctgtccacaggtcatgtgactgggtgtcgggcacggttcccttgcagcaatgaacagtacatctgtggatgaaggtgggcagatagagggttggcggggggtggagcggggcactgatcatggcagcctgctgtggccagccccaagggcttcccggtgacttctcagagcctgaatgtctcccctggacaggtgggatcgagggaatgccatgaaggtgggcatgagggggaatctcgccaggggtacagtgcgtctacactgcttttcagactagtgccacgcaggcactaggtctcactggctgaggggcagcctctgtccccaggcgccgcgacttgccccatctgctgcagaggaggcccacctgtggtgagcattgtggtcttggggcctgcaggcgcccttgtggagttaccatggtgaccgcagccccttggactggtgctggggattcagacaccaggtcacgtaggccttggctcgtggcatggccaagccctggggtctgtcggggttggcagggcaggcttcctggaggaggggctgaggccgcgtattctccctctcatcctgccatccgctgcggctactcttcagggccacaactgtcacagaacgaggaacccgggccttgtgcagaagagccttgtgtaggtggattgagaagagagtcccagaggagaagctgagccctctgctgacttgcccccagctcatttctgcttgacctttccttgttgccgtttttgcttggaaactatattgtggacctcatcattctgggaaaaggtggttcacgagaaagcacagtcatgtgtcaattaacagtgcagatgcattctgagaaatgcgttgttaggtgatttcatcatcctgcaacatcagagtgtgccccgcgctcatggatgagacagcctgccccacacccaggctgtgggggacgggatggcctgttgcttctggaccagacgcctgcacagcacattaactgtgctgaatgctgtaggcagttgtaacgcaacggtaagtgtctgtatctaaacgtagaaaaggtatagtgaaaatatgatgtaaaagagaaaacatgcttcagctgtggagggcacatgcttcagctgattggggcctgtggacaaggctgtgggtgtccgtgagggagagggagtgcctctgaggcccttctgcaggctggatgaacaacacacttaggccacactcagtttatactaaaaaaatgtcttcaataacacattcacttgagcttttttctaacttgttaattttatgaattttaaaaacatttttgactcttttttaataacagcttaaaacacacatcgtacagctgtacaaaaatatttttcctttttttattttgtttttttgagacggggtcttgttgtgtcacccaggttagagtgtagtggcgccgtctcggctcactacagtgagcctcagcctcccgggcttaattgatctcctgcctcagccccccaagtagctgggaccacaggcacgtgccaccatgttgcccaggctggtcttgaactcctggactgaagcggtcctcctgttaggggtggcgaatatttgagttgtcagtggtgaattcacatgggtctgcagcagcctcaactcttgcctccttggaagaaagaattcatctgaagagcataaggcggaaaaaggagactgaggcaagtttccgagcgggagtggaagtttattaaaaagctttagagcaggaaagaaaaagtacacttggaagagacccaagcacgcactgtggaggtggagtgcagcatttgaccttttgacttggggtcttatatattggcgtacttctggggccttgtgtcccttttcccatgatgctttccttagggtgggctgcctgcatgcacggtgccctccttgcactccggacgtgagcattcgcagtgggtttgtgaagttgtatgtatgtttgcctgaggctgcttcccttttccggtaggacgcccccagaaggtcatactctgccattttgtctcttaatgcgcttgctctagcccacttacccaattcctgagattttattggaagccgctggtgagcaatttcaagtgcctttatctattgggaaattgcctctccctggcgcctgcgaccaatgatcatttttagacagccagtgtaacaactgtgggaccatcacctcaaggactaaactgattttttatcttgcccaaattcctatctaaggggtctggggagtcctgccctgcaaatcagaaattctcatcagatgggttttatttaaccctatatattatgacttactttccaacctgaccctggcataacattacaagtcaaggaagaaaaatcaaagtagtttacctcaaaatgtgtttaaccatattttgaaatgaccctacaaagctgttttgtgtgggggaaaatttgcatctgtaaagaatctctgttaacatagctagatctttttcttccagaccctcccaatcctgaggagattaaaactctagcaccttttgaaagatctgaataggaaacagttgtcatctattgtctctaagggcagcgactattagacttcaaagaactttggtctccacaatctttatcttaacttgaacatttcctttctatcaatcccaggtcttcagacaaactcaaccaattgtcaaccagaaaatgtttaaattcacttgtagcctggaagcttccctcccctgctccgacctttgagttgtcccgcctttctggaccaaaccaatgtatttctcaaatgtatttgattgatgtctcatgcctccctaaaatacataaaaccaagctgtgccccgaccaccttgggcacatgttctcaggacctcctgaggactgtgtcatgggccatggtcactcatatttggctcagaataaatctcttcaatattttacagaaaac

SEQ ID NO: 65722 - DNA, 3459 bp, Homo sapiens
ctcaatcagctttatgcagagaagaagcttactgagctcactgctggtgctggtgtaggcaagtgctgctttggcaatctgggctgacctggcttgtctcctcagaactccttctccaaccctggagcaggcttccatgctgctgtgggcgtccttgctggcctttgctccagtctgtggacaatctgcagctgcacacaaacctgtgatttccgtccatcctccatggaccacattcttcaaaggagagagagtgactctgacttgcaatggatttcagttctatgcaacagagaaaacaacatggtatcatcggcactactggggagaaaagttgaccctgaccccaggaaacaccctcgaggttcgggaatctggactgtacagatgccaggcccggggctccccacgaagtaaccctgtgcgcttgctcttttcttcagactccttaatcctgcaggcaccatattctgtgtttgaaggtgacacattggttctgagatgccacagaagaaggaaagagaaattgactgctgtgaaatatacttggaatggaaacattctttccatttctaataaaagctgggatcttcttatcccacaagcaagttcaaataacaatggcaattatcgatgcattggatatggagatgagaatgatgtatttagatcaaatttcaaaataattaaaattcaagaactatttccacatccagagctgaaagctacagactctcagcctacagaggggaattctgtaaacctgagctgtgaaacacagcttcctccagagcggtcagacaccccacttcacttcaacttcttcagagatggcgaggtcatcctgtcagactggagcacgtacccggaactccagctcccaaccgtctggagagaaaactcaggatcctattggtgtggtgctgaaacagtgaggggtaacatccacaagcacagtccctcgctacagatccatgtgcagcggatccctgtgtctggggtgctcctggagacccagccctcagggggccaggctgttgaaggggagatgctggtccttgtctgctccgtggctgaaggcacaggggataccacattctcctggcaccgagaggacatgcaggagagtctggggaggaaaactcagcgttccctgagagcagagctggagctccctgccatcagacagagccatgcagggggatactactgtacagcagacaacagctacggccctgtccagagcatggtgctgaatgtcactgtgagagagaccccaggcaacagagatggccttgtcgccgcgggagccactggagggctgctcagtgctcttctcctggctgtggccctgctgtttcactgctggcgtcggaggaagtcaggagttggtttcttgggagacgaaaccaggctccctcccgctccaggcccaggagagtcctcccattccatctgccctgcccaggtggagcttcagtcgttgtatgttgatgtacaccccaaaaagggagatttggtatactctgagatccagactactcagctgggagaagaagaggaagctaatacctccaggacacttctagaggataaggatgtctcagttgtctactctgaggtaaagacacaacacccagataactcagctggaaagatcagctctaaggatgaagaaagttaagagaatgaaaagttacgggaacgtcctactcatgtgatttctcccttgtccaaagtcccaggcccagtgcagtccttgcggcacctggaatgatcaactcattccagctttctaattcttctcatgcatatgcattcactcccaggaatactcattcgtctactctgatgttgggatggaatggcctctgaaagacttcactaaaatgaccaggatccacagttaagagaagaccctgtagtatttgctgtgggcctgacctaatgcattccctagggtctgctttagagaagggggataaagagagagaaggactgttatgaaaaacagaagcacaaattttggtgaattgggatttgcagagatgaaaaagactgggtgacctggatctctgcttaatacatctacaaccattgtctcactggagactcacttgcatcagtttgtttaactgtgagtggctgcacaggcactgtgcaaacaatgaaaagccccttcacttctgcctgcacagcttacactgtcaggattcagttgcagattaaagaacccatctggaatggtttacagagagaggaatttaaaagaggacatcagaagagctggagatgcaagctctaggctgcgcttccaaaagcaaatgataattatgttaatgtcattagtgacaaagatttgcaacattagagaaaagagacacaaatataaaattaaaaacttaagtaccaactctccaaaactaaatttgaacttaaaatattagtataaactcataataaactctgcctttaaaaaaagataaatatttcctacgtctgttcactgaaataattaccaaccccttagcaataagcactccttgcagagaggttttattctctaaataccattcccttctcaaaggaaataaggttgcttttcttgtaggaactgtgtctttgagttactaattagtttatatgagaataattcttgcaataaatgaagaaggaataaaagaaataggaagccacaaatttgtatggatatttcatgatacacctactggttaaataattgacaaaaaccagcagccaaatattagaggtctcctgatggaagtgtacaataccacctacaaattatccatgccccaagtgttaaaactgaatccattcaagtctttctaactgaatacttgttttatagaaaatgcatggagaaaaggaatttgtttaaataacattatgggattgcaaccagcaaaacataaactgagaaaaagttctatagggcaaatcacctggcttctataacaaataaatgggaaaaaaatgaaataaaaagaagagagggaggaagaaagggagagagaagaaaagaaaaatgaagaaaagtaattagaatattttcaacataaagaaaagacgaatatttaaggtgacagatatcccaactacgctgatttgatctttacaaattatatgagtgtatgaatttgtcacatgtatcacccccaaaaaaagagaaaaagaaaaatagaagacatataaattaaatgagacgagacatgtcgaccaaaaggaatgtgtgggtcttgtttggatcctgactcaaattaagaaaaaataaaactacctacgaaatactaagaaaaatttgtatactaatattaagaaattgttgtgtgttttggatataagtgatagtttattgtagtgatgtttttataaaagcaaaaggatattcactttcagcgcttatactgaagtattagattaaagcttattaacgta

SEQ ID NO: 65723 - DNA, 388 bp, Homo sapiens
caaggtctcactatgttgcccaggctggaaagccagtattttttaaccaaacaagagtaatcattctgactatgagacgatgattgttacgatgatgtcagagactccctaaccttgtttccaggcagcctgtccataccacagctccagggtttttttaaaaagaacagtctcactctatatagacctattgaaactctgattaaaccattcaggctttccagttccctactggctgctgactttctccaaatcctctttctcctctgccgctctccctgggtatctcactctcccgcatgttacagtgttccagggattattatgtgtttctgtgtctcacaggctccctcccgctccaggcccaggagagtcctcccattccatc

SEQ ID NO: 65724 - DNA, 2475 bp, Homo sapiens
ctcaatcagctttatgcagagaagaagcttactgagctcactgctggtgctggtgtaggcaagtgctgctttggcaatctgggctgacctggcttgtctcctcagaactccttctccaaccctggagcaggcttccatgctgctgtgggcgtccttgctggcctttgctccagtctgtggacaatctgcagctgcacacaaacctgtgatttccgtccatcctccatggaccacattcttcaaaggagagagagtgactctgacttgcaatggatttcagttctatgcaacagagaaaacaacatggtatcatcggcactactggggagaaaagttgaccctgaccccaggaaacaccctcgaggttcgggaatctggactgtacagatgccaggcccggggctccccacgaagtaaccctgtgcgcttgctcttttcttcagactccttaatcctgcaggcaccatattctgtgtttgaaggtgacacattggttctgagatgccacagaagaaggaaagagaaattgactgctgtgaaatatacttggaatggaaacattctttccatttctaataaaagctgggatcttcttatcccacaagcaagttcaaataacaatggcaattatcgatgcattggatatggagatgagaatgatgtatttagatcaaatttcaaaataattaaaattcaagaactatttccacatccagagctgaaagctacagactctcagcctacagaggggaattctgtaaacctgagctgtgaaacacagcttcctccagagcggtcagacaccccacttcacttcaacttcttcagagatggcgaggtcatcctgtcagactggagcacgtacccggaactccagctcccaaccgtctggagagaaaactcaggatcctattggtgtggtgctgaaacagtgaggggtaacatccacaagcacagtccctcgctacagatccatgtgcagcggatccctgtgtctggggtgctcctggagacccagccctcagggggccaggctgttgaaggggagatgctggtccttgtctgctccgtggctgaaggcacaggggataccacattctcctggcaccgagaggacatgcaggagagtctggggaggaaaactcagcgttccctgagagcagagctggagctccctgccatcagacagagccatgcagggggatactactgtacagcagacaacagctacggccctgtccagagcatggtgctgaatgtcactgtgagagagaccccaggcaacagagatggccttgtcgccgcgggagccactggagggctgctcagtgctcttctcctggctgtggccctgctgtttcactgctggcgtcggaggaagtcaggagttggtttcttgggagacgaaaccaggctccctcccgctccaggcccaggagagtcctcccattccatctgccctgcccaggtggagcttcagtcgttgtatgttgatgtacaccccaaaaagggagatttggtatactctgagatccagactactcagctgggagaagaagaggaagctaatacctccaggacacttctagaggataaggatgtctcagttgtctactctgaggtaaagacacaacacccagataactcagctggaaagatcagctctaaggatgaagaaagttaagagaatgaaaagttacgggaacgtcctactcatgtgatttctcccttgtccaaagtcccaggcccagtgcagtccttgcggcacctggaatgatcaactcattccagctttctaattcttctcatgcatatgcattcactcccaggaatactcattcgtctactctgatgttgggatggaatggcctctgaaagacttcactaaaatgaccaggatccacagttaagagaagaccctgtagtatttgctgtgggcctgacctaatgcattccctagggtctgctttagagaagggggataaagagagagaaggactgttatgaaaaacagaagcacaaattttggtgaattgggatttgcagagatgaaaaagactgggtgacctggatctctgcttaatacatctacaaccattgtctcactggagactcacttgcatcagtttgtttaactgtgagtggctgcacaggcactgtgcaaacaatgaaaagccccttcacttctgcctgcacagcttacactgtcaggattcagttgcagattaaagaacccatctggaatggtttacagagagaggaatttaaaagaggacatcagaagagctggagatgcaagctctaggctgcgcttccaaaagcaaatgataattatgttaatgtcattagtgacaaagatttgcaacattagagaaaagagacacaaatataaaattaaaaacttaagtaccaactctccaaaactaaatttgaacttaaaatattagtataaactcataataaactctgccttta

SEQ ID NO: 65725 - DNA, 276 bp, Homo sapiens
gtgctgacttcatatctcatcctgtgacttggaatgccttaagcatctgggaatgtagcctagtagttctcagcctcattttacccatctcctactcaagatttagttgctctggttcacacgcctctgacatatcaaaatattctttataccagggagccatattttaaggtgaaattggctgcactccttcaatgtgctctaggggaagaaaccttgaattgaaattaaaaggagttggtttctaatcataaaactgtcattgagtagagctac

SEQ ID NO: 65726 - DNA, 989 bp, Homo sapiens
attttgtgagtttttttcattcaacagaaatttaactgttaaattaagggaaacctacaaagtatactttcataaaatgctagagttcaggttattaaaaagccattttaaaagatacatctgaatcttagtgggtttgtcttaattacattattaatgaactgctgtgtctatgctataatgtttgagttagtgccctctggcttcagaaaattatggtcttaattattgtttataataatacaaaattgaaaataaccgaaaagtccatcaattgggaattgattaaattataaatattcataagatagtgtgccaggcagacatttacaaggatctgatagaatgatgaatgcttatacattgtcatagaaagagcttcaaatatatttctaagtaaggaaaaaaaaacagttatataacagtatgtataatatggccttatttatgtaaaagattcttctacatgtttatatgggcatttgtaaaatctaaaaggatacataccaagctgttaacagtgttagctctaggagggtggaattatggaggaacatttacgttttctgtatctttataacatattttacaacgatcctgtagtactagggaaaaaagctttttccattttgaaaaatttcaagcatttatgcaaatgtttttcgaatactaaaaattccaaatttctctaaatactaaatgttctctactaaaaattatttgaaattatcttttgtgggtttgcagtgaatggcgtacttgtcataaataactgttttctttgagaattcatccttgcaacaaagataactataaaggtactctattaactgaaacaagacttggggtttttcttttaggtatttctgctattgtttcattccaaacaataattactataaaatttgaatttgttttcacctctctggctctgatgaagtacagttaaactccacacaacagctaaggtattaataatttagaaaagt

SEQ ID NO: 65727 - DNA, 397 bp, Homo sapiens
gaggctggagaatcacttgaacccaggaggcagaggttgcagtgagccgagatggcgccattgcactccagcctgggccagagcaaggttccttctcaaaaaacttggaaatctgttgggaagtagggggagggcaaggttaaaacctatgcaggtgtgtcaattagacttgttccaacttgagaacctgaattttgcatgtaattgaaatgttccagaacaagtctggcagtttcataagggagtttttagatgccaatacattgcagataaccatattggctacattaggggaatgagcatggataggtgcctccaagttggtagaatagcatgagaagttttcaaaagtaaccgctttaaggttatgttcagtatttgctaagtaaacaaagat

SEQ ID NO: 65728 - DNA, 426 bp, Homo sapiens
tgtactatcacatgtgagctctatttgataacataaaaatgctatacttattttagggtaaatttgttacactatttgataccaggaaataagttgtaaataacaagcaactgctcttccctcacatctggcctttcaaaatccctcccagctcccggggtgcaagtgaaatatccggaggctgccagggtccatcctagagagcagagggggtgcgtggagctccacatcccctacagggtcttttcatcttggtagtaggcacgcagttttagaaccctcaagaaataaaatatataaaggagaaccagactcaatcaagagaactgataaattctagagagctttggcttagaaactgtcaaaggataggatttccaggcagtattgaagtccagtaagggaacagcagcatgagttaagttt

SEQ ID NO: 65729 - DNA, 342 bp, Homo sapiens
gcacagggagagcagacggggtcatgtggcgagggcaggagcaaggagtcggggcaagtcccaaacttttaaacaaccagatctcacgggaactcaccaagcaagaactcacttatcaccgaggggatggtgctagaccattcatgacagatctgtccccacgatccagccacctcccaccagaccccacctccaacgtcggaatcccatttccacatgagatctggaggggacagacgtctaaaccatatcacagacactaagaaaggcatacgtggacgaatggggtgagttcagatttggatgtaggagccaagggtggctatggaggaatttgagcag

SEQ ID NO: 65730 - DNA, 455 bp, Homo sapiens
tctgtgcatctttctgcttccctagatcctacagttttaatgttatcttctggagtatcacagcaacttccttaacgcaaggtttctccaactctgagttgtcacttagtgggtagtgaaatcagatgagtcatgcagtttcaccatttagaaaatgcaaaaggttaggtagaaaatgtcagcgtacatcctgtgtagaaaaagtaagtcttgttgtgaaacctctttcagtttgtgtgtgcgtgtccccggatctgtgtacatactgggcaacagggaaaatgcattttgtaggtcaaaatatttggagaaatacgtttctacttagtctcactgggtctgtcttttctgtttccaaactattgtgtacacttagaggaagagtggaaaccctccagcaggtcctgtcagtctgcagtttacaaatctcccctcaggataagagttcctgttca

SEQ ID NO: 65731 - DNA, 494 bp, Homo sapiens
tgaaagaacacaaaaggaaatcgttttaagctgtttaacctcccaacaaaattatcttaggtgaaacaccacaagtacagtacaaaaacatgtcaccaattcgagatttgtgtctctaaagaaatacatacctacacaggtaagaagtttctggctgtgaccgaaggtagaacagtcaaaagtttagagcttttattagctaaaataagatcccagctagccaaggatccagcgaaaagttttgttgattacaaataaaatcggatccattaaataggtaaggacgactgcttcatttcctcacttaccagaaatgacataagactccctcagatcgttctgatttagtacaaacacagtctctcatagaaactcctatcattaatggtaaaggtataaaaaacaattactcgtcaagcaaactctcaatttacctgaccttcctgccttgctcaagtctaccactctgaaaaccacagttacagccctaagtg

SEQ ID NO: 65732 - DNA, 531 bp, Homo sapiens
gtgccaggcgtggttctcagatcttcacatacactaacacacttagtcctcacagctctcaaaataggagggccaggtggggtggcttacacctgtaattccagcactttgggaggctgaggcaggcagatcacctgaggtcaggagttcaagacaagcctggccaacatggtgaaaccccatttttactaaaaatacaaaaattagccggatgtggtggcaggcacctgtaatcctagctactcaggaggctgaggcaggagaatcacttgaacctgggagatggaggttgcggtgagccgaggtcgcaccactgcactccagcctgggcaacagagtgagactccgtctcagaaaaacaaaaaaaaaaaaaataggaggattgtttttacaggtaacaaaactgaggtgtagagagattcagtggcttgctcaaggtcaaagtgaggaaccaggatgtatatgcagattgtctgactctagagtccatgctctcaatcatgagctatattacttcccatagaaagctaa

SEQ ID NO: 65733 - DNA, 362 bp, Homo sapiens
aatggctttgttgatttggttaaattagttgaccctttcatcaattcttcttcagttctgtcatcattctttccctcctctttcaatttcctatctaaaatgttccaaaataattataaaagtcagagaggcatgatgaacctttttattggaaagagatgaaccttccaaactcattctcagctcatcatcacagcatttggaatatggagtaaaaattcatattttgcaagtgccttggtgcttaagcatgcagaacagatgtttcatttcacaagttttcccaatttattacacataatatctctatttctgtgagacaaacactgctttggggaataggcctttccatttcctccagc

SEQ ID NO: 65734 - DNA, 2666 bp, Homo sapiens
gctcagctggtagtttgacctccgttggtgcaatgccagagatgggattgtcagccaccacactgccaccaccctgcacacagtctgggtccctccgagagaagcacgccaaccttaacatcccctacagcatcttggtgcttcacacaccatttaggaggccaccctaacgaggcaagaggacatgggggtgtgcagaagttctgttcttagtgagaatggctggcctgagaatccagctcacctcctctgcccacagtctggactgcttgtgggaaggccatctcctcctgtctggtggtacctccactctgggcagggagggcctgtctgtgactcgctctggaccccacttcccgctctggccaagggctgtcttctgtgcacatagctcaggagcctgcagcagttccctgtatgggtggatgtcctcaggggccaagaagagaagaatggggacaacagaaacctgctttgtaggggattatgtagactaaaagcctagaagttctgcccacatccttatgacgcagccaatctggagcttcatgtttccttctaaaagtagtaaccgggtagaagtgggtgacccattgaggacacatgatgtgaggtatttctgccggattctaggttagcaaagactcaaatgggtgactcatgaatgaagggagaacaggcacaggacttaatgaaaagagtttcttgaacttagttttctgaatgggggtggggagttggggcacgtgtgtgtaaggggaggctgcctcactttgaaggaatggtgttggctaacaggatccatgaaattcctaggtcagttgaataataactgaactactggtttgactgtggattatttcctgggtattagtgggacccaacagcacattgctattaatagtatggaaataatggtccctctgtttcattgaattgctgaagtaatgataatgccatgaaccaggagaagatggttgtgggggtttctaggaagcagctgctgtgacaggccaatcccaggcttgcccccgagccctcctgtccttctgggtttgtgtttgccttgcctggtgcttcctccctcattgtgttgttgaatagacctaggcagccttgtatccatagaaagcctccactgctgggccggggagggggttgtggtaagggccctctggaaatcaagcagagaatgcctttgcagtggtctcccgggcattgggcagggcctagccttttgcagcccccagaggaccttgcctgcataaagcactcagaagggttagccacctggtgattttgtctctagtgaaactgtgtttgccgataatcatccacatagccacctctgtcctcgcagtttggatgcctttttttgacacctgcgctaggttcttgtatgctggcttttcttaaaggaacagcagagtagaaaagaggttgagaatgttttctagcaggcagaatgtgcatacatgttttcatgagtgtcctttgggtgctgtttcttttaaatcctctgtgcacagggctctggcctttagtaaactgtttttctgtcttacgtcatgctgactgggtgctaggggctgattacaaaggggaagagttgaacagacatcaggggccgatgaaaccaaaggactaggagtcaggagaacaagtcagggattaggagacagcggtttggtttattgttatccagctggaggactcctaggggcagcagcaggaggaataccagggccacggaggggccaggagtctcacagtggagggcagactctaacagatgccagctgaacgctcgctggccctggatgtcatacgagttggggaccagaaatctgggctcagagaacccgtccagggagatttgaagccatgggttatcttctagagttgatactgataatatattttaatttttattgatgtttaataccttctgaaacaggagggtaagatcagatgggaagcccctctgttgaaggatcttgggaaccttggtggtttttttttttttttggttttttttttttgatcgagctgtggacatccttcttaattcgattctgaggatttgtttaactaaaaagttcccaaacacagaaagggcctccccacctgctttggggagctgtctgtgctgggagtgccaggcatcccatgggacccatcactgccagtgtctgtgcctcccagaggtcagccgtgtctgccctggctctgtctcctctgtgacagggcagagcatttctggtcagtttctccatggtgcctcccacccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaattcta

SEQ ID NO: 65735 - DNA, 1151 bp, Homo sapiens
gctcagctggtagtttgacctccgttggtgcaatgccagagatgggattgtcagccaccacactgccaccaccctgcacacagtctgggtccctccgagagaagcacgccaaccttaacatcccctacagcatcttggtgcttcacacaccatttaggaggccaccctaacgaggcaagaggacatgggggtgtgcagaagttctgttcttagtgagaatggctggcctgagaatccagctcacctcctctgcccacagtctggactgcttgtgggaaggccatctcctcctgtctggtggtacctccactctgggcagggagggcctgtctgtgactcgctctggaccccacttcccgctctggccaagggctgtcttctgtgcacatagctcaggagcctgcagcagttccctgtatgggtggatgtcctcaggggccaagaagagaagaatggggacaacagaaacctgctttgtaggggattatgtagactaaaagcctagaagttctgcccacatccttatgacgcagccaatctggagcttcatgtttccttctaaaagtagtaaccgggtagaagtgggtgacccattgaggacacatgatgtgaggtatttctgccggattctaggttagcaaagactcaaatgggtgactcatgaatgaagggagaacaggcacaggacttaatgaaaagagtttcttgaacttagttttctgaatgggggtggggagttggggcacgtgtgtgtaaggggaggctgcctcactttgaaggaatggtgttggctaacaggatccatgaaattcctaggtcagttgaataataactgaactactggtttgactgtggattatttcctgggtattagtgggacccaacagcacattgctattaatagtatggaaataatggtccctctgtttcattgaattgctgaagtaatgataatgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaattcta

SEQ ID NO: 65736 - DNA, 160 bp, Homo sapiens
ctgtctaccagatgaggaaatggcagttctgagaagtcactggtctagatcccgcaggtggcacgtgacagctagggttcaaaacgttctcaccaaatccaatgctcctcacatattaattttataaccagacaaataaatattagagacaaccaccatc

SEQ ID NO: 65737 - DNA, 143 bp, Homo sapiens
ctgtctaccagatgaggaaatggcagttctgagaagtcactggtctagatcccgcaggtggcacgtgacagctagggttcaaaacgttctcaccaaatccaatgctcctcatccaagacctgggaccagcaggtaccgactga

SEQ ID NO: 65738 - DNA, 474 bp, Homo sapiens
gtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtgactc

SEQ ID NO: 65739 - DNA, 1127 bp, Homo sapiens
  misc_feature (272)..(272): n is a, c, g, or t
ctgcacgtttgagagctgtgttggcaagacctcaggacagagtgccctctgtgtctggtggtgattctcagacaccatcacattctgatcctgcattgtgggccattctactgagtgcatctactcctaagttaaggactttcatgaacctgtctcatgactggccctttctaaagggaagtatggccgttagttactttaatcaacatttcccaatgggtaaggaacagtctgtgaacttatgagttttgttttgttttgttttgtttttnatttttgagacagagtctcgctctgtcgcccagactagagtgcagtggtgcaatctcagctcaccacaacctcgacctcttgggttcaagtgattctcctgcctcagcctcccaagtggctgggattataggtgcccatcaccacgcatggcctatttttgtacttttagtagagacagggtttcaccctgttggcgaggctggtctcaaactcctgacaccaggtgatctgcccacctcggcctcccgaagtgctgggattacaggcgggagccaccatgatggccaacttttgaattctgaaccagttgtttgagtaccagagctcttcaataccttgaagaaagattcaggggagagctgttgtgaacagcttgccccagggaaaggacaaggctaagacaatttcagggcttccttgggaaaacagaattgaggaaatgcaaagtgaagaaattgtagctgtcaggaacaagagaagagggacgggaaacctgctactgaggtttggaggtattcctctggagttttcacttataccattctctcatgcccaggaagctgctcatcaccaaaccacaagtcttcctctaactcagtcacaactaagcttctatccagacactgatgatactgtaactgttttgttgtgcttctgattagttgccctgtcaaccataagcagcctataaacagggcctggctccatccttgttacttccccattgcactgaattcagtatttttccctcaaggtagatagttgtggggcagcatccctaaaaatatctagttatattatggcatccagtaaatgtttccttaattacttacctccattaacaagctttatgc

SEQ ID NO: 65740 - DNA, 117 bp, Homo sapiens
aatatccattgagtactgtaaacgcaggagctacatagaaaaacgggcttcaaaaatctgcacagaggtttgcttgagaatttagctacacaaatatgtgtagaagtgaaaaaaaaa

SEQ ID NO: 65741 - DNA, 921 bp, Homo sapiens
taaactttgctgtggcaaagactttggtttaacatgtacacactcgcacccccctgctgccctatggagttttctttttaaaatgccttcatgctgtcagaataatttcttgacttagaatcagagaatcctagacttttctcccctctaaaattaactacatgtctgaatttttctccctctcttctgaatcctcagaaagcaagccctcttctctacactccccagttagaagatgcatctctttctctttagtgaccataaaactagacacacagtcagccttctgcatctgtggattcaaccaaccatggattcaaaatatttgaggaaaaaaaaagtacctctttactgaatatgtatatactgttttccttgtcatgatttcctaaacaatacagtataatggtgatttatataatatttacataatattaggtgtcataagtaatttagagatgatttaacttatatgggagcgtatgtgtaggttgtatgcaaatactacacgatattttatcagggacttgagtgtctgtggattttggcatcctcggggggtgcttggaaccagtccccctggatacctgaggagtgactgtactgtgtgatagcagcagtatgggatggaaagatgagatcctagtggtgcaggtacatcagttggacatttggtgtaactcaccaaaagtgaaaaaaacagagaaacaatatttgtggtgaattaagagattgagaagcaccgaattgaattgagaggtggttttgacttcctgaaatctccccacaccattttataactcctcagtttttccatttagctttaccttcttctgtgacagagattcattcattgtctttccttactatgctttaagcaactcttacacttctgtatagaaaaggtgtttcattccctct

SEQ ID NO: 65742 - DNA, 3139 bp, Homo sapiens
  misc_feature (403)..(403): n is a, c, g, or t
  misc_feature (456)..(456): n is a, c, g, or t
  misc_feature (606)..(606): n is a, c, g, or t
  misc_feature (2080)..(2080): n is a, c, g, or t
  misc_feature (2082)..(2082): n is a, c, g, or t
  misc_feature (2349)..(2349): n is a, c, g, or t
  misc_feature (2403)..(2403): n is a, c, g, or t
  misc_feature (2749)..(2749): n is a, c, g, or t
  misc_feature (2871)..(2871): n is a, c, g, or t
  misc_feature (2962)..(2962): n is a, c, g, or t
  misc_feature (2977)..(2977): n is a, c, g, or t
  misc_feature (3048)..(3048): n is a, c, g, or t
aaacatacatatatttattgcacaggattgaggaagaatttatcaaacaaaaagctctccaactggtcagtatctcactgaaataaataaacctttcattgacagaggagagctgtgctataaaggagaaatacagaggcacatcttttaaaaattcacttattcatttaacagaggtgacaaaacccatagagagctggaatggaattgaggacaaaattagtttaaaaatgcaaatcttgtttttagaataacttcttcagaaatagaagaaacacaaagaagcaaaatttccatacgtgggtttccagatactggctcacccatgtattatccacagattgctaggtttctccaccagaaatgaaaatttgtttcaatcctcttttaatataaaatatgngagaaaacttttcagaaaaccaaaatactttttaagtaatacaaacatctttnttttttttttttttgagacagagtctcgctctgtcatccaggctgaagtgcagtggcgcgagctccgctcactgcaagctccgcctcccgggttcacgccattctcctgcctcagcctcctgagtagctgggactacaggcgcccaacancatgcccggctaattttttgtatttttttagtagagacggagtttcaccgtgctagccaggatggtcttgatctcctgacctcgtgatccgcccgcctcggccttccaaagtgctgggattacaggcgtgagccaccgcgcccggcccggccaaacatcttttattttacctagtttgggacttgctttccttgattatgctcaacaaagggaagaattgtgaagaaaaatctaaaacttggatcaatgtattgtcggggacacacccaagtacctcccttttgtataaagatcaattaatgtatcacacattatatatgcatgaataaatctgagaaaagaaacgtgaaataattcctaagaaattaaacgcaaatgtgatcaaatcgatggcaaataagaacagagaaaagagcagacaaaaatttgtaatggggaagtcctaacaaagataagatcagttttctctaccaaagaataggagggataccttagtgcagataattaaaattaatataaacacagggagaaacaagacattttcaccgtgaaaactatgcacattgcgttgtacattgcaattggtatttatgttaactatgacaggtatgcttttatttttttcatgaatattggctatggtattatttgaaatcaggatatgacctcacaaatgataaaaatttggtcataaattacctctatttacaaggtgaattaagaataaagcaaatgtaaaaattcagagattgaaatatcatgtaaatatgtgtgttctaataattttgaaacagtacaacttacaaagaattgacaggagaaaaggtggcatttgggggctaaaattaattagctgattttctgatctgtagtagcttggatttctttaaagcgtatctcagaatgcataacctaaacttatatgacaattttaagatggtagtagattgatttgaaaatggctccaatacttaacgtctctttgaatctatgtcctttgcaatctctctttgcatatgtgcccttagtaatgtgacattacagatctaaccatctaaccagggatagagatgatttctgcatcctcttgattattgataattcttgcaatttaatgtgatcaacagaatgaggtgaaaacacagtcgcaagaaatgcgggcttgaggttcaggaggacttcccctgagaatcctgccaccacattgtgaacaagtcaaggctaccatggtagcgtatgacagaagatggagaccaatcaacagcaatctggcccatgattatgtaaaccaacagaatcaagattagcagagctaactatctgtttcactgttgattgcagaggcatgagaaaacacatcctagaggataactaatacccaactgatacaaacatagatgaatcacttttgagtcactttgtttcagtgtcatttgctaagcagtaatattgaccttaaataaagaaagggtangnctaaacataacttttctatttgatgacttaattttaattattaaaaaatattttcaccatatatctcacaaacaacacctgactctacggtatataacaaagacacctaaaaaaataagaatttttaaaacttgagaaatataggtgagcttgactagtaagtattaaaaaagttaaaataaaaataataatctggttttgatcaaatatatgtacaaaataatgtaatattgaataaaatatatcaaaaacttgaaaaatagaganaaatacaatgatcccctcacctaaatccaaaaatgagacacattctgaagtatnatttacacaccactttaaattaatttgtagatatcctgacattcatccatgactaaacgagaatgttttaaataacagtatacttgcttatattgcaacaataatattattcataacaaaattaacaaattatcaaatattgccttgtatcttattcatattcaacatttttcaaaacatcttacgtaagtgtttttaattttattttattttgtgttttgttacaggatattgtcaagcaacaatgatttgtccaacttttgtacctctttagtctctgaatctacaataattccctcccaaacaaacacacttttttcctttcattctttcctacttcctcccntctctctgcatttctatcctgctctctgtctttctctttctccctctctctctgcataatgtagtttgcaatttaagaagccattgtcttctacaatatcttttgttctggaagaaaaatcnctcaactgttttcgataagggtgatccaaaaaagacaaaaatgtatcctgctttacactaaaatgctcaaggtaaattaattataaatatngatacttaaactaantaatgcctggtagaaataagtgctaccctttttatattaaactctaccatctttgctcaaaatcttcccangaataaacatatcacacatttggtatgtattttgagttacccacagatattccttttctcctaggccttaattcttaaccttagactccgg

SEQ ID NO: 65743 - DNA, 14896 bp, Homo sapiens
cagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttttcactgactatgggcagatcccaaaggtggaacgctgtgacatggatgggcagaaccgcaccaagctcgtcgacagcaagattgtgtttcctcatggcatcacgctggacctggtcagccgccttgtctactgggcagatgcctatctggactatattgaagtggtggactatgagggcaagggccgccagaccatcatccagggcatcctgattgagcacctgtacggcctgactgtgtttgagaattatctctatgccaccaactcggacaatgccaatgcccagcagaagacgagtgtgatccgtgtgaaccgctttaacagcaccgagtaccaggttgtcacccgggtggacaagggtggtgccctccacatctaccaccagaggcgtcagccccgagtgaggagccatgcctgtgaaaacgaccagtatgggaagccgggtggctgctctgacatctgcctgctggccaacagccacaaggcgcggacctgccgctgccgttccggcttcagcctgggcagtgacgggaagtcatgcaagaagccggagcatgagctgttcctcgtgtatggcaagggccggccaggcatcatccggggcatggatatgggggccaaggtcccggatgagcacatgatccccattgaaaacctcatgaacccccgagccctggacttccacgctgagaccggcttcatctactttgccgacaccaccagctacctcattggccgccagaagattgatggcactgagcgggagaccatcctgaaggacggcatccacaatgtggagggtgtggccgtggactggatgggagacaatctgtactggacggacgatgggcccaaaaagacaatcagcgtggccaggctggagaaagctgctcagacccgcaagactttaatcgagggcaaaatgacacaccccagggctattgtggtggatccactcaatgggtggatgtactggacagactgggaggaggaccccaaggacagtcggcgtgggcggctggagagggcgtggatggatggctcacaccgagacatctttgtcacctccaagacagtgctttggcccaatgggctaagcctggacatcccggctgggcgcctctactgggtggatgccttctacgaccgcatcgagacgatactgctcaatggcacagaccggaagattgtgtatgaaggtcctgagctgaaccacgcctttggcctgtgtcaccatggcaactacctcttctggactgagtatcggagtggcagtgtctaccgcttggaacggggtgtaggaggcgcaccccccactgtgacccttctgcgcagtgagcggccccccatctttgagatccgaatgtatgatgcccagcagcagcaagttggcaccaacaaatgccgggtgaacaatggcggctgcagcagcctgtgcttggccacccctgggagccgccagtgcgcctgtgctgaggaccaggtgttggacgcagacggcgtcacttgcttggcgaacccatcctacgtgcctccaccccagtgccagccaggcgagtttgcctgtgccaacagccgctgcatccaggagcgctggaagtgtgacggagacaacgattgcctggacaacagtgatgaggccccagccctctgccatcagcacacctgcccctcggaccgattcaagtgcgagaacaaccggtgcatccccaaccgctggctctgcgacggggacaatgactgtgggaacagtgaagatgagtccaatgccacttgttcagcccgcacctgcccccccaaccagttctcctgtgccagtggccgctgcatccccatctcctggacgtgtgatctggatgacgactgtggggaccgctctgatgagtctgcttcgtgtgcctatcccacctgcttccccctgactcagtttacctgcaacaatggcagatgtatcaacatcaactggagatgcgacaatgacaatgactgtggggacaacagtgacgaagccggctgcagccactcctgttctagcacccagttcaagtgcaacagcgggcgttgcatccccgagcactggacctgcgatggggacaatgactgcggagactacagtgatgagacacacgccaactgcaccaaccaggccacgaggccccctggtggctgccacactgatgagttccagtgccggctggatggactatgcatccccctgcggtggcgctgcgatggggacactgactgcatggactccagcgatgagaagagctgtgagggagtgacccacgtctgcgatcccagtgtcaagtttggctgcaaggactcagctcggtgcatcagcaaagcgtgggtgtgtgatggcgacaatgactgtgaggataactcggacgaggagaactgcgagtccctggcctgcaggccaccctcgcacccttgtgccaacaacacctcagtctgcctgccccctgacaagctgtgtgatggcaacgacgactgtggcgacggctcagatgagggcgagctctgcgaccagtgctctctgaataacggtggctgcagccacaactgctcagtggcacctggcgaaggcattgtgtgttcctgccctctgggcatggagctggggcccgacaaccacacctgccagatccagagctactgtgccaagcatctcaaatgcagccaaaagtgcgaccagaacaagttcagcgtgaagtgctcctgctacgagggctgggtcctggaacctgacggcgagagctgccgcagcctggaccccttcaagccgttcatcattttctccaaccgccatgaaatccggcgcatcgatcttcacaaaggagactacagcgtcctggtgcccggcctgcgcaacaccatcgccctggacttccacctcagccagagcgccctctactggaccgacgtggtggaggacaagatctaccgcgggaagctgctggacaacggagccctgactagtttcgaggtggtgattcagtatggcctggccacacccgagggcctggctgtagactggattgcaggcaacatctactgggtggagagtaacctggatcagatcgaggtggccaagctggatgggaccctccggaccaccctgctggccggtgacattgagcacccaagggcaatcgcactggatccccgggatgggatcctgttttggacagactgggatgccagcctgccccgcattgaggcagcctccatgagtggggctgggcgccgcaccgtgcaccgggagaccggctctgggggctggcccaacgggctcaccgtggactacctggagaagcgcatcctttggattgacgccaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatggctcccaatccctgtgaggccaatgggggccagggcccctgctcccacctgtgtctcatcaactacaaccggaccgtgtcctgcgcctgcccccacctcatgaagctccacaaggacaacaccacctgctatgagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcagacttgccaaatgcccacgggctggctgtggactgggtctcccgaaacctgttctggacaagctatgacaccaataagaagcagatcaatgtggcccggctggatggctccttcaagaacgcagtggtgcagggcctggagcagccccatggccttgtcgtccaccctctgcgtgggaagctctactggaccgatggtgacaacatcagcatggccaacatggatggcagcaatcgcaccctgctcttcagtggccagaagggccccgtgggcctggctattgacttccctgaaagcaaactctactggatcagctccgggaaccataccatcaaccgctgcaacctggatgggagtgggctggaggtcatcgatgccatgcggagccagctgggcaaggccaccgccctggccatcatgggggacaagctgtggtgggctgatcaggtgtcggaaaagatgggcacatgcagcaaggctgacggctcgggctccgtggtccttcggaacagcaccaccctggtgatgcacatgaaggtctatgacgagagcatccagctggaccataagggcaccaacccctgcagtgtcaacaacggtgactgctcccagctctgcctgcccacgtcagagacgacccgctcctgcatgtgcacagccggctatagcctccggagtggccagcaggcctgcgagggcgtaggttcctttctcctgtactctgtgcatgagggaatcaggggaattcccctggatcccaatgacaagtcagatgccctggtcccagtgtccgggacctcgctggctgtcggcatcgacttccacgctgaaaatgacaccatctactgggtggacatgggcctgagcacgatcagccgggccaagcgggaccagacgtggcgtgaagacgtggtgaccaatggcattggccgtgtggagggcattgcagtggactggatcgcaggcaacatctactggacagaccagggctttgatgtcatcgaggtcgcccggctcaatggctccttccgctacgtggtgatctcccagggtctagacaagccccgggccatcaccgtccacccggagaaagggtacttgttctggactgagtggggtcagtatccgcgtattgagcggtctcggctagatggcacggagcgtgtggtgctggtcaacgtcagcatcagctggcccaacggcatctcagtggactaccaggatgggaagctgtactggtgcgatgcacggacagacaagattgaacggatcgacctggagacaggtgagaaccgcgaggtggttctgtccagcaacaacatggacatgttttcagtgtctgtgtttgaggatttcatctactggagtgacaggactcatgccaacggctctatcaagcgcgggagcaaagacaatgccacagactccgtgcccctgcgaaccggcatcggcgtccagcttaaagacatcaaagtcttcaaccgggaccggcagaaaggcaccaacgtgtgcgcggtggccaatggcgggtgccagcagctgtgcctgtaccggggccgtgggcagcgggcctgcgcctgtgcccacgggatgctggctgaagacggagcatcgtgccgcgagtatgccggctacctgctctactcagagcgcaccattctcaagagtatccacctgtcggatgagcgcaacctcaatgcgcccgtgcagcccttcgaggaccctgagcacatgaagaacgtcatcgccctggcctttgactaccgggcaggcacctctccgggcacccccaatcgcatcttcttcagcgacatccactttgggaacatccaacagatcaacgacgatggctccaggaggatcaccattgtggaaaacgtgggctccgtggaaggcctggcctatcaccgtggctgggacactctctattggacaagctacacgacatccaccatcacgcgccacacagtggaccagacccgcccaggggccttcgagcgtgagaccgtcatcactatgtctggagatgaccacccacgggccttcgttttggacgagtgccagaacctcatgttctggaccaactggaatgagcagcatcccagcatcatgcgggcggcgctctcgggagccaatgtcctgacccttatcgagaaggacatccgtacccccaatggcctggccatcgaccaccgtgccgagaagctctacttctctgacgccaccctggacaagatcgagcggtgcgagtatgacggctcccaccgctatgtgatcctaaagtcagagcctgtccaccccttcgggctggccgtgtatggggagcacattttctggactgactgggtgcggcgggcagtgcagcgggccaacaagcacgtgggcagcaacatgaagctgctgcgcgtggacatcccccagcagcccatgggcatcatcgccgtggccaacgacaccaacagctgtgaactctctccatgccgaatcaacaacggtggctgccaggacctgtgtctgctcactcaccagggccatgtcaactgctcatgccgagggggccgaatcctccaggatgacctcacctgccgagcggtgaattcctcttgccgagcacaagatgagtttgagtgtgccaatggcgagtgcatcaacttcagcctgacctgcgacggcgtcccccactgcaaggacaagtccgatgagaagccatcctactgcaactcccgccgctgcaagaagactttccggcagtgcagcaatgggcgctgtgtgtccaacatgctgtggtgcaacggggccgacgactgtggggatggctctgacgagatcccttgcaacaagacagcctgtggtgtgggcgagttccgctgccgggacgggacctgcatcgggaactccagccgctgcaaccagtttgtggattgtgaggacgcctcagatgagatgaactgcagtgccaccgactgcagcagctacttccgcctgggcgtgaagggcgtgctcttccagccctgcgagcggacctcactctgctacgcacccagctgggtgtgtgatggcgccaatgactgtggggactacagtgatgagcgcgactgcccaggtgtgaaacgccccagatgccctctgaattacttcgcctgccctagtgggcgctgcatccccatgagctggacgtgtgacaaagaggatgactgtgaacatggcgaggacgagacccactgcaacaagttctgctcagaggcccagtttgagtgccagaaccatcgctgcatctccaagcagtggctgtgtgacggcagcgatgactgtggggatggctcagacgaggctgctcactgtgaaggcaagacgtgcggcccctcctccttctcctgccctggcacccacgtgtgcgtccccgagcgctggctctgtgacggtgacaaagactgtgctgatggtgcagacgagagcatcgcagctggttgcttgtacaacagcacttgtgacgaccgtgagttcatgtgccagaaccgccagtgcatccccaagcacttcgtgtgtgaccacgaccgtgactgtgcagatggctctgatgagtcccccgagtgtgagtacccgacctgcggccccagtgagttccgctgtgccaatgggcgctgtctgagctcccgccagtgggagtgtgatggcgagaatgactgccacgaccagagtgacgaggctcccaagaacccacactgcaccagcccagagcacaagtgcaatgcctcgtcacagttcctgtgcagcagtgggcgctgtgtggctgaggcactgctctgcaacggccaggatgactgtggcgacagctcggacgagcgtggctgccacatcaatgagtgtctcagccgcaagctcagtggctgcagccaggactgtgaggacctcaagatcggcttcaagtgccgctgtcgccctggcttccggctgaaggatgacggccggacgtgtgctgatgtggacgagtgcagcaccaccttcccctgcagccagcgctgcatcaacacccatggcagctataagtgtctgtgtgtggagggctatgcaccccgcggcggcgacccccacagctgcaaggctgtgactgacgaggaaccgtttctgatcttcgccaaccggtactacctgcgcaagctcaacctggacgggtccaactacacgttacttaagcagggcctgaacaacgccgttgccttggattttgactaccgagagcagatgatctactggacagatgtgaccacccagggcagcatgatccgaaggatgcaccttaacgggagcaatgtgcaggtcctacaccgtacaggcctcagcaaccccgatgggctggctgtggactgggtgggtggcaacctgtactggtgcgacaaaggccgggacaccatcgaggtgtccaagctcaatggggcctatcggacggtgctggtcagctctggcctccgtgagcccagggctctggtggtggatgtgcagaatgggtacctgtactggacagactggggtgaccattcactgatcggccgcatcggcatggatgggtccagccgcagcgtcatcgtggacaccaagatcacatggcccaatggcctgacgctggactatgtcactgagcgcatctactgggccgacgcccgcgaggactacattgaatttgccagcctggatggctccaatcgccacgttgtgctgagccaggacatcccgcacatctttgcactgaccctgtttgaggactacgtctactggaccgactgggaaacaaagtccattaaccgagcccacaagaccacgggcaccaacaaaacgctcctcatcagcacgctgcaccggcccatggacctgcatgtcttccatgccctgcgccagccagacgtgcccaatcacccctgcaaggtcaacaatggtggctgcagcaacctgtgcctgctgtcccccgggggagggcacaaatgtgcctgccccaccaacttctacctgggcagcgatgggcgcacctgtgtgtccaactgcacggctagccagtttgtatgcaagaacgacaagtgcatccccttctggtggaagtgtgacaccgaggacgactgcggggaccactcagacgagcccccggactgccctgagttcaagtgccggcccggacagttccagtgctccacaggtatctgcacaaaccctgccttcatctgcgatggcgacaatgactgccaggacaacagtgacgaggccaactgtgacatccacgtctgcttgcccagtcagttcaaatgcaccaacaccaaccgctgtattcccggcatcttccgctgcaatgggcaggacaactgcggagatggggaggatgagagggactgccccgaggtgacctgcgcccccaaccagttccagtgctccattaccaaacggtgcatcccccgggtctgggtctgcgaccgggacaatgactgtgtggatggcagtgatgagcccgccaactgcacccagatgacctgtggtgtggacgagttccgctgcaaggattcgggccgctgcatcccagcgcgttggaagtgtgacggagaggatgactgtggggatggctcggatgagcccaaggaagagtgtgatgaacgcacctgtgagccataccagttccgctgcaagaacaaccgctgcgtgcccggccgctggcagtgcgactacgacaacgattgcggtgacaactccgatgaagagagctgcacccctcggccctgctccgagagtgagttctcctgtgccaacggccgctgcatcgcggggcgctggaaatgcgatggagaccacgactgcgcggacggctcggacgagaaagactgcaccccccgctgtgacatggaccagttccagtgcaagagcggccactgcatccccctgcgctggcgctgtgacgcagacgccgactgcatggacggcagcgacgaggaggcctgcggcactggcgtgcggacctgccccctggacgagttccagtgcaacaacaccttgtgcaagccgctggcctggaagtgcgatggcgaggatgactgtggggacaactcagatgagaaccccgaggagtgtgcccggttcgtgtgccctcccaaccggcccttccgttgcaagaatgaccgcgtctgtctgtggatcgggcgccaatgcgatggcacggacaactgtggggatgggactgatgaagaggactgtgagccccccacagcccacaccacccactgcaaagacaagaaggagtttctgtgccggaaccagcgctgcctctcctcctccctgcgctgcaacatgttcgatgactgcggggacggctctgacgaggaggactgcagcatcgaccccaagctgaccagctgcgccaccaatgccagcatctgtggggacgaggcacgctgcgtgcgcaccgagaaagcggcctactgtgcctgccgctcgggcttccacaccgtgcccggccagcccggatgccaagacatcaacgagtgcctgcgcttcggcacctgctcccagctctgcaacaacaccaagggcggccacctctgcagctgcgctcggaacttcatgaagacgcacaacacctgcaaggccgaaggctctgagtaccaggtcctgtacatcgctgatgacaatgagatccgcagcctgttccccggccacccccattcggcttacgagcaggcattccagggtgacgagagtgtccgcattgatgctatggatgtccatgtcaaggctggccgtgtctattggaccaactggcacacgggcaccatctcctaccgcagcctgccacctgctgcgcctcctaccacttccaaccgccaccggcgacagattgaccggggtgtcacccacctcaacatttcagggctgaagatgcccagaggcatcgccatcgactgggtggccggaaacgtgtactggaccgactcgggccgagatgtgattgaggtggcgcagatgaagggcgagaaccgcaagacgctcatctcgggcatgattgacgagccccacgccattgtggtggacccactgagggggaccatgtactggtcagactggggcaaccaccccaagattgagacggcagcgatggatgggacgcttcgggagacactggtgcaggacaacattcagtggcccacaggcctggccgtggattatcacaatgagcggctgtactgggcagacgccaagctttcagtcatcggcagcatccggctcaatggcacggaccccattgtggctgctgacagcaaacgaggcctaagtcaccccttcagcatcgacgtctttgaggattacatctatggtgtcacctacatcaataatcgtgtcttcaagatccataagtttggccacagccccttggtcaacctgacagggggcctgagccacgcctctgacgtggtcctttaccatcagcacaagcagcccgaagtgaccaacccatgtgaccgcaagaaatgcgagtggctctgcctgctgagccccagtgggcctgtctgcacctgtcccaatgggaagcggctggacaacggcacatgcgtgcctgtgccctctccaacgccccccccagatgctccccggcctggaacctgtaacctgcagtgcttcaacggtggcagctgtttcctcaatgcacggaggcagcccaagtgccgctgccaaccccgctacacgggtgacaagtgtgaactggaccagtgctgggagcactgtcgcaatgggggcacctgtgctgcctccccctctggcatgcccacgtgccggtgccccacgggcttcacgggccccaaatgcacccagcaggtgtgtgcgggctactgtgccaacaacagcacctgcactgtcaaccagggcaaccagccccagtgccgatgcctacccggcttcctgggcgaccgctgccagtaccggcagtgctctggctactgtgagaactttggcacatgccagatggctgctgatggctcccgacaatgccgctgcactgcctactttgagggatcgaggtgtgaggtgaacaagtgcagccgctgtctcgaaggggcctgtgtggtcaacaagcagagtggggatgtcacctgcaactgcacggatggccgggtggcccccagctgtctgacctgcgtcggccactgcagcaatggcggctcctgtaccatgaacagcaaaatgatgcctgagtgccagtgcccaccccacatgacagggccccggtgtgaggagcacgtcttcagccagcagcagccaggacatatagcctccatcctaatccctctgctgttgctgctgctgctggttctggtggccggagtggtattctggtataagcggcgagtccaaggggctaagggcttccagcaccaacggatgaccaacggggccatgaacgtggagattggaaaccccacctacaagatgtacgaaggcggagagcctgatgatgtgggaggcctactggacgctgactttgccctggaccctgacaagcccaccaacttcaccaaccccgtgtatgccacactctacatggggggccatggcagtcgccactccctggccagcacggacgagaagcgagaactcctgggccggggccctgaggacgagataggggaccccttggcatagggccctgccccgtcggactgcccccagaaagcctcctgccccctgccggtgaagtccttcagtgagcccctccccagccagcccttccctggccccgccggatgtataaatgtaaaaatgaaggaattacattttatatgtgagcgagcaagccggcaagcgagcacagtattatttctccatcccctccctgcctgctccttggcacccccatgctgccttcagggagacaggcagggagggcttggggctgcacctcctaccctcccaccagaacgcaccccactgggagagctggtggtgcagccttcccctccctgtataagacactttgccaaggctctcccctctcgccccatccctgcttgcccgctcccacagcttcctgagggctaattctgggaagggagagttctttgctgcccctgtctggaagacgtggctctgggtgaggtaggcgggaaaggatggagtgttttagttcttgggggaggccaccccaaaccccagccccaactccaggggcacctatgagatggccatgctcaacccccctcccagacaggccctccctgtctccagggcccccaccgaggttcccagggctggagacttcctctggtaaacattcctccagcctcccctcccctggggacgccaaggaggtgggccacacccaggaagggaaagcgggcagccccgttttggggacgtgaacgttttaataatttttgctgaattctttacaactaaataacacagatattcttataaataaaattgtaaaaaaaaaaa

SEQ ID NO: 65744 - DNA, 1526 bp, Homo sapiens
ggcgggggggtggggtgaagggtttggatttcggtggcatggtggacgcacccaccgatacagcagtgcccatcgccacaaggtgtgctcaggaaagctctaacgcatcgttcagtcctactgctcgcctgtagtgctgccatttgcctgcaatgtgaagacgcacatacagaagcagcagacaggcaggcagggcggacacaggcagcgaacaatgggcggacctccgccaacttgtgggcggcgtgcaaggcagagcaagtagcagtgacccagaagggtgacagggtgcttgctagcggttgccattcaggactcgacagccaatgcttgatccgccaggcacgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttattataataaacaccctcaccactacaatcttcctaggaacagcatatgacgcactctcgcctgaactctacacaacatattttgtcaccaagaccctacttctaacctccctgttcttatgaattcgaacagcatacccccgattccgctatatgacttggggatactcaaggagacgg

SEQ ID NO: 65745 - DNA, 1660 bp, Homo sapiens
cagcggtgcgagctccaggcccatgcactgaggaggcggaaacaaggggagcccccagagctccatcaagccccctccaaaggctcccctacccggtccacgccccccaccccccctccccgcctcctcccaattgtgcatttttgcagccggaggcggctccgagatggggctgtgagcttcgcccggggagggggaaagagcagcgaggagtgaagcgggggggtggggtgaagggtttggatttcggggcagggggcgcacccccgtcagcaggccctccccaaggggctcggaactctacctcttcacccacgcccctggtgcgctttgccgaaggaaagaataagaacagagaaggaggagggggaaaggaggaaaagggggaccccccaactggggggggtgaaggagagaagtagcaggaccagaggggaaggggctgctgcttgcatcagcccacaccatgctgaccccgccgttgctcctgctgctgcccctgctctcagctctggtcgcggcggctatcgacgcccctaagacttgcagccccaagcagtttgcctgcagagatcaaataacctgtatctcaaagggctggcggtgcgacggtgagagggactgcccagacggatctgacgaggcccctgagatttgtccacagagtaaggcccagcgatgccagccaaacgagcataactgcctgggtactgagctgtgtgttcccatgtcccgcctctgcaatggggtccaggactgcatggacggctcagatgaggggccccactgccgagagctccaaggcaactgctctcgcctgggctgccagcaccattgtgtccccacactcgatgggcccacctgctactgcaacagcagctttcagcttcaggcagatggcaagacctgcaaagattttgatgagtgctcagtgtacggcacctgcagccagctatgcaccaacacagacggctccttcatatgtggctgtgttgaaggatacctcctgcagccggataaccgctcctgcaaggccaagaacgagccagtagaccggccccctgtgctgttgatagccaactcccagaacatcttggccacgtacctgagtggggcccaggtgtctaccatcacacctacgagcacgcggcagaccacagccatggacttcagctatgccaacgagaccgtatgctgggtgcatgttggggacagtgctgctcagacgcagctcaagtgtgcccgcatgcctggcctaaagggcttcgtggatgagcacaccatcaacatctccctcagtctgcaccacgtggaacagatggccatcgactggctgacaggcaacttctactttgtggatgacatcgatgataggatctttgtctgcaacagaaatggggacacatgtgtcacattgctagacctggaactctacaaccccaagggcattgccctggaccctgccatggggaaggtgtttattataataaacaccctcaccactacaatcttcctaggaacagcatatgacgcactctcgcctgaactctacacaacatattttgtcaccaagaccctacttctaacctccctgttcttatgaattcgaacagcatacccccgattccgctatatgacttggggatactcaaggagacgg

SEQ ID NO: 65746 - DNA, 2216 bp, Homo sapiens
  misc_feature (874)..(874): n is a, c, g, or t
  misc_feature (1027)..(1027): n is a, c, g, or t
  misc_feature (1079)..(1079): n is a, c, g, or t
  misc_feature (1103)..(1103): n is a, c, g, or t
  misc_feature (1141)..(1141): n is a, c, g, or t
  misc_feature (1146)..(1146): n is a, c, g, or t
  misc_feature (1157)..(1157): n is a, c, g, or t
  misc_feature (1159)..(1159): n is a, c, g, or t
  misc_feature (1163)..(1163): n is a, c, g, or t
  misc_feature (1166)..(1166): n is a, c, g, or t
  misc_feature (1177)..(1178): n is a, c, g, or t
  misc_feature (1184)..(1184): n is a, c, g, or t
  misc_feature (1297)..(1297): n is a, c, g, or t
ctcagctctgcaaagagctcctccccctccaggaaaagcacttctccccaggcagggcggtcagtcccctcagcgcacctgcatgcacacacaccacctcacaaccacacactgcatgcacacacatacaccacagccacacactgtgcatacacgcacaccccacaacccacatactgcatgcacacacacacacctacaagctgcatgctgcatacacaagtcatacaggagataaactcagagtcccagccccaaatagaccccatctcttgctcagttgctgtcatcctagacctgtttctttcgccacatttctataatctgccagtgtctgcaaggagaagacatggggggttttctacctaaggcagaagggcccgggagccaactccagaaacttctgccctcctttctggtcagagaacaagactgggaccagcacctggacaagcttcatatgctgcagcagaagaggattctagagtctccactgcttcgagcatccaaggaaaatgacctgtctgttcttaggcaacttctactggactgcacctgtgacgttcgacaaagaggagccctgggggagacggcgctgcacatagcagccctctatgacaacttggaggcggccttggtgctgatggaggctgccccagagctggtctttgagcccaccacatgtgaggcttttgcaggtcagactgcactgcacatcgctgttgtgaaccagaatgtgaacctggtgcgtgccctgctcacccgcagggccagtgtctctgccagagccacaggcactgccttccgccgtagtccccgcaacctcatctactttggggagcaccctttgtcctttgctgcctgtgtgaacagngaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggngaccacctgcagcccctggacctctgtgcccaatcaccagggtctcaccccnttcaagctggctggagtggagggnaacactgtgatgttccagcacctgatgcagaagcggangcacntccagtggacntntggnccnctgacctccannctctangacctcacagagatcgactcctggggagaggagctgtccttcctggagcttgtggtctcctctgataaacgagaggctcgccaaattctggaacagaccccagtgaaggagcnggtgagcttcaagtggaacaagtatggccggccgtacttctgcatcctggctgccttgtacctgctctacatgatctgctttaccacgtgctgcgtctaccgcccccttaagtttcgtggtggcaaccgcactcattctcgagacatcaccatcctccagcaaaaactactacaggaggcctatgagacacgtgaagatatcatcaggctggtgggggagctggtgagcatcgttggggctgtgatcatcctgctcctagagattccagacatcttcagggttggtgcctctcgctattttggaaagacgattcttggggggccattccatgtcatcatcatcacctatgcctccctggtgctggtgaccatggtgatgcggctcaccaacaccaatggggaggtggtgcccatgtcctttgccctggtgctgggctggtgcagtgtcatgtatttcactcgaggattccagatgctgggtcccttcaccatcatgatccagaagatgatttttggagacctaatgcgtttctgctggctgatggctgtggtcatcttgggatttgcctccggtaaggcaccatacactcctctactagatcagcagatctagttctccagaaagttcactctcattcttgctctcagttctcatttgcacttcattttgctttctttttttttgtttgttttttgttttgttttttcctgttggaaggtaagtctaaaagcacacccatatttataggaccaggggccactcaggttggcctggaacgtaaagccatgtgttcagggccaataagatttatgttcactaactgccttgcaagatctttaaaggagagacaggaaaagacttttggtgagaacagggcattaaacaggaaagactggccagtcatggatctcagaaaac

SEQ ID NO: 65747 - DNA, 3007 bp, Homo sapiens
  misc_feature (874)..(874): n is a, c, g, or t
  misc_feature (1027)..(1027): n is a, c, g, or t
  misc_feature (1079)..(1079): n is a, c, g, or t
  misc_feature (1103)..(1103): n is a, c, g, or t
  misc_feature (1141)..(1141): n is a, c, g, or t
  misc_feature (1146)..(1146): n is a, c, g, or t
  misc_feature (1157)..(1157): n is a, c, g, or t
  misc_feature (1159)..(1159): n is a, c, g, or t
  misc_feature (1163)..(1163): n is a, c, g, or t
  misc_feature (1166)..(1166): n is a, c, g, or t
  misc_feature (1177)..(1178): n is a, c, g, or t
  misc_feature (1184)..(1184): n is a, c, g, or t
  misc_feature (1297)..(1297): n is a, c, g, or t
  misc_feature (1937)..(1937): n is a, c, g, or t
  misc_feature (1945)..(1945): n is a, c, g, or t
  misc_feature (1952)..(1952): n is a, c, g, or t
  misc_feature (1958)..(1958): n is a, c, g, or t
  misc_feature (1961)..(1961): n is a, c, g, or t
  misc_feature (1964)..(1964): n is a, c, g, or t
  misc_feature (1967)..(1968): n is a, c, g, or t
  misc_feature (1970)..(1970): n is a, c, g, or t
  misc_feature (1973)..(1973): n is a, c, g, or t
  misc_feature (1983)..(1983): n is a, c, g, or t
  misc_feature (1993)..(1993): n is a, c, g, or t
  misc_feature (2002)..(2002): n is a, c, g, or t
  misc_feature (2015)..(2015): n is a, c, g, or t
  misc_feature (2037)..(2037): n is a, c, g, or t
  misc_feature (2046)..(2046): n is a, c, g, or t
  misc_feature (2068)..(2068): n is a, c, g, or t
  misc_feature (2070)..(2070): n is a, c, g, or t
  misc_feature (2076)..(2076): n is a, c, g, or t
  misc_feature (2094)..(2094): n is a, c, g, or t
  misc_feature (2101)..(2101): n is a, c, g, or t
  misc_feature (2112)..(2112): n is a, c, g, or t
  misc_feature (2116)..(2116): n is a, c, g, or t
  misc_feature (2127)..(2127): n is a, c, g, or t
  misc_feature (2932)..(2932): n is a, c, g, or t
ctcagctctgcaaagagctcctccccctccaggaaaagcacttctccccaggcagggcggtcagtcccctcagcgcacctgcatgcacacacaccacctcacaaccacacactgcatgcacacacatacaccacagccacacactgtgcatacacgcacaccccacaacccacatactgcatgcacacacacacacctacaagctgcatgctgcatacacaagtcatacaggagataaactcagagtcccagccccaaatagaccccatctcttgctcagttgctgtcatcctagacctgtttctttcgccacatttctataatctgccagtgtctgcaaggagaagacatggggggttttctacctaaggcagaagggcccgggagccaactccagaaacttctgccctcctttctggtcagagaacaagactgggaccagcacctggacaagcttcatatgctgcagcagaagaggattctagagtctccactgcttcgagcatccaaggaaaatgacctgtctgttcttaggcaacttctactggactgcacctgtgacgttcgacaaagaggagccctgggggagacggcgctgcacatagcagccctctatgacaacttggaggcggccttggtgctgatggaggctgccccagagctggtctttgagcccaccacatgtgaggcttttgcaggtcagactgcactgcacatcgctgttgtgaaccagaatgtgaacctggtgcgtgccctgctcacccgcagggccagtgtctctgccagagccacaggcactgccttccgccgtagtccccgcaacctcatctactttggggagcaccctttgtcctttgctgcctgtgtgaacagngaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggngaccacctgcagcccctggacctctgtgcccaatcaccagggtctcaccccnttcaagctggctggagtggagggnaacactgtgatgttccagcacctgatgcagaagcggangcacntccagtggacntntggnccnctgacctccannctctangacctcacagagatcgactcctggggagaggagctgtccttcctggagcttgtggtctcctctgataaacgagaggctcgccaaattctggaacagaccccagtgaaggagcnggtgagcttcaagtggaacaagtatggccggccgtacttctgcatcctggctgccttgtacctgctctacatgatctgctttaccacgtgctgcgtctaccgcccccttaagtttcgtggtggcaaccgcactcattctcgagacatcaccatcctccagcaaaaactactacaggaggcctatgagacacgtgaagatatcatcaggctggtgggggagctggtgagcatcgttggggctgtgatcatcctgctcctagagattccagacatcttcagggttggtgcctctcgctattttggaaagacgattcttggggggccattccatgtcatcatcatcacctatgcctccctggtgctggtgaccatggtgatgcggctcaccaacaccaatggggaggtggtgcccatgtcctttgccctggtgctgggctggtgcagtgtcatgtatttcactcgaggattccagatgctgggtcccttcaccatcatgatccagaagatgatttttggagacctaatgcgtttctgctggctgatggctgtggtcatcttgggatttgcctccgcgttctatatcattttccagacagaggacccaaccagtctggggcaattctatgactaccccatggcnctgttcancaccttngagctnttnctnacnntnatngatggcaccngccaactacnacgtggacntgcccttcatgtncagcatcacctatgctgccttngccatcatngccacactgctcatgctcaacntnttcatngccatgatgggcgacacncactggngggtggcccangagngggatgagctntggagggcccaggtcgtggccaccacagtgatgctggagcggaagctgcctcgctgcctgtggcctcgctccgggatctgtgggtgcgaattcgggctgggggaccgctggttcctgcgggttgagaaccacaatgatcagaatcctctgcgagtgcttcgctatgtggaagtgttcaagaactcagacaaggaggatgaccaggagcatccatctgagaaacagccctctggggctgagagtgggactctagccagagcctctttggctcttccaacttcctccctgtcccggaccgcgtcccagagcagcagtcaccgaggctgggagatccttcgtcaaaacaccctggggcacttgaatcttggactgaaccttagtgagggggatggagaggaggtctaccatttttgattaacatcgctatcactcttgaccttactcccggttggcctgggggcggggacagagacggagacctctgcctatgcaagtgtctaacttctgtgcctgttaatcatgggagggtgagacagaacaatccctaaagggtcatgcctcacacttcacatcaagaatttctggcaatgggcaatggtcatcgattgtctcacgtattttctgggctcttgcaagtcacccatctcaggaaaaaggaggttggcaactaaagacatgaggcagggatgctagattaatgtcaggaccatttctcttctgccccacgcagcccctagaaagtagtaagctgtgaggctattctggctccccagggcttacgtgggaagagccaggcatggcatanaggttgtggcccttctttttttcccagcctcctgtaggtctctctctccacttagcaagcaaacaccaactgcaa

SEQ ID NO: 65748 - DNA, 391 bp, Homo sapiens
ccgaagcttcctccgcctcaggcacaagaccttcacagacagagggatggaggtagaatggagctggtagaactatgggggcctcttgatctgttagcgttagctgctcaaaagcagtggaaaaggaatcatcccaccctttcttccttctgtttcctgcagatgatttttggagacctaatgcgtttctgctggctgatggctgtggtcatcttgggatttgcctccggtaaggcaccatacactcctctactagatcagcagatctagttctccagaaagttcactctcattcttgctctcagttctcatttgcacttcattttgctttctttttttttgtttgttttttgttttgttttttcctgttggaaggtaagtctaaaagcac

SEQ ID NO: 65749 - DNA, 1999 bp, Homo sapiens
ttaaatgaatttttgaaaagcaacagtgttttattactggaaagtgttacagacagatattgtgaaatttttccttgggcttctttcaatttcgttcaattctcgtccagtattctcataacatttggatcaggtactttatcaccttgtagtgtcactgttcctttctgtatcctctcgaagcctcctgttactcgttttctaattctcttccagcccactgcacgatctagtgtcgaatggatgaaacagctgagcagaacagttctttagctgtcggcctaaatgaccaacttcatgacctctcaaggtctcgctccccggctgcacgcagctcagcttccaacattcgggaaaggcgtgccggatcgcgaggggccgctgggaccgagtcccggacgtcgcgacgcgcagggggctgctgcggccggcggtctcgggaaaagtgaggggacggaggcgcccaagcaacgtgggtttcgggaactgctcttcagcaaaagcccttgtcagtttaaaagaaggaagcttatctaacacgtggaatgaaaagtacagttctttacagaaaacacctgtttggaaaggcaggaatacaagctctgctgtggaaatgcctttcagaaattcaaaacgaagtcgacttttttctgatgaagatgataggcaaataaatacaaggtcacctaaaagaaaccagagggttgcaatggttccacagaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattcaccaaggaacatatcaagaacatcagggacatgaacacagaagcagaaacactggcaatcatattgcatgccagtcagcattggattcacgcggagatttgcgacaatcggtctcggggacttgaacaggtgaacacagggcctaaacacagtttgggtaacggtcaccggattgctatgagattgtcccaacacgggggtccagctgagagatcagcgaaggtattaacccgtgtgtagcggcgaaacacccggcacagtgtccgcgcgacatcctcagcggagaacccgtctttacaggggcactgggcgacagcaattcagatcgcgactggtgaccaattgtgccagcggacgcccctgagcaaccaactcagagtaacgaaacatgatcacgagcactaacaaacgataagtgaagcgaacggcccacggctgcaacgactgcttcctcatcatacatctttcattatgag

SEQ ID NO: 65750 - DNA, 1606 bp, Homo sapiens
cagtctccgccccacaatgcaccgcggcgggcagcctttgaaaaagcggcgcggctcgttcaagatggcggagctcgaccagttgcctgacgagagctcttcagcaaaagcccttgtcagtttaaaagaaggaagcttatctaacacgtggaatgaaaagtacagttctttacagaaaacacctgtttggaaaggcaggaatacaagctctgctgtggaaatgcctttcagaaattcaaaacgaagtcgacttttttctgatgaagatgataggcaaataaatacaaggtcacctaaaagaaaccagagggttgcaatggttccacagaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattcaccaaggaacatatcaagaacatcagggacatgaacacagaagcagaaacactggcaatcatattgcatgccagtcagcattggattcacgcggagatttgcgacaatcggtctcggggacttgaacaggtgaacacagggcctaaacacagtttgggtaacggtcaccggattgctatgagattgtcccaacacgggggtccagctgagagatcagcgaaggtattaacccgtgtgtagcggcgaaacacccggcacagtgtccgcgcgacatcctcagcggagaacccgtctttacaggggcactgggcgacagcaattcagatcgcgactggtgaccaattgtgccagcggacgcccctgagcaaccaactcagagtaacgaaacatgatcacgagcactaacaaacgataagtgaagcgaacggcccacggctgcaacgactgcttcctcatcatacatctttcattatgag

SEQ ID NO: 65751 - DNA, 1865 bp, Homo sapiens
ttcccgcctgctgcttgcccagcggttgcaccggccgggacggacggccgtgccctccgctgggcaggtgggctgactgccagccccactgtggtcccctagtcctcccactccggtgttgccgccgcgtcgccgcctttgttatggtgtctgtgtgttggtttctggggttgtgtgagcgccagggccggaaaccgagagcccgggagtccagcctgtgccaggcggaggcggtggctgctcccctggcgccactccggcccccagccgaggtggagggaagagcggcccctgggcgcgggggctgtcctcgccgcctgcaccactcgcccggcgccgagagacgccgccggggctcttcagcaaaagcccttgtcagtttaaaagaaggaagcttatctaacacgtggaatgaaaagtacagttctttacagaaaacacctgtttggaaaggcaggaatacaagctctgctgtggaaatgcctttcagaaattcaaaacgaagtcgacttttttctgatgaagatgataggcaaataaatacaaggtcacctaaaagaaaccagagggttgcaatggttccacagaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattcaccaaggaacatatcaagaacatcagggacatgaacacagaagcagaaacactggcaatcatattgcatgccagtcagcattggattcacgcggagatttgcgacaatcggtctcggggacttgaacaggtgaacacagggcctaaacacagtttgggtaacggtcaccggattgctatgagattgtcccaacacgggggtccagctgagagatcagcgaaggtattaacccgtgtgtagcggcgaaacacccggcacagtgtccgcgcgacatcctcagcggagaacccgtctttacaggggcactgggcgacagcaattcagatcgcgactggtgaccaattgtgccagcggacgcccctgagcaaccaactcagagtaacgaaacatgatcacgagcactaacaaacgataagtgaagcgaacggcccacggctgcaacgactgcttcctcatcatacatctttcattatgag

SEQ ID NO: 65752 - DNA, 458 bp, Homo sapiens
tccatactgctgataatccagagttagctcagttttccaagtatagaattgtattttggaacaaaaatgggagggttcggctttttcattaaatgaaaacatttctatcatagcctttcagaaattcaaaacgaagtcgacttttttctgatgaagatgataggcaaataaatacaaggtcacctaaaagaaaccagagggttgcaatggttccacaggtatgtgtgtgctaaaattttgtttcattggaaaggaagtaagcaaatgctcagcctaataaagtttatatttctgttacattttgagtaacaagttcttttctttaaattcgtacggctgctctggtcctgttttagttacctagaaaatgttatttttttgatcaactttaaaacaggatagaaagccagtcattagtcctacaaatgcacacttttaagcatggagatagtggaaga

SEQ ID NO: 65753 - DNA, 1501 bp, Homo sapiens
cagtctccgccccacaatgcaccgcggcgggcagcctttgaaaaagcggcgcggctcgttcaagatggcggagctcgaccagttgcctgacgagagctcttcagcaaaagcccttgtcagtttaaaagaaggaagcttatctaacacgtggaatgaaaagtacagttctttacagaaaacacctgtttggaaaggcaggaatacaagctctgctgtggaaatgaaatttacagcaacaatgtcaacaccagataagaaagcttcacagaagattggttttcgattacgtaatctgctcaagcttcctaaagcacataaatggtgtatatacgagtggttctattcaaatatagataaaccactttttgaaggtgataatgacttctgtgtatgtctaaaggaatcttttcctaatttgaaaacaagaaagttaacaagagtagaatggggaaaaattcggcggcttatgggaaaaccacggagatgttcttctgcattttttgaggaagagagatcagcattaaaacagaaacggcagaaaataaggctcttacaacaaaggaaagttgcagatgtttcacaattcaaagatctcccagatgaaattcctttgcctctggttattggaacgaaagttacagcacgattacgtggtgttcatgatggtttgttcactggacaaatagatgctgtggatactcttaatgctacttatagagtaacttttgataggacagggcttggaacccataccatccctgactatgaagttctcagtaatgaacctcatgagacaatgccaattgctgcctttggacaaaaacagcggccttctcgattttttatgaccccaccacggttacattatactcctcctctccagtcaccaattatagataatgatcctttattaggacagtcgccgtggagaagtaaaatttctggctctgacactgaaacattaggtggttttccagtagaatttcttatccaagtgaccagattatcaaaaattctcatgattcaccaaggaacatatcaagaacatcagggacatgaacacagaagcagaaacactggcaatcatattgcatgccagtcagcattggattcacgcggagatttgcgacaatcggtctcggggacttgaacaggtgaacacagggcctaaacacagtttgggtaacggtcaccggattgctatgagattgtcccaacacgggggtccagctgagagatcagcgaaggtattaacccgtgtgtagcggcgaaacacccggcacagtgtccgcgcgacatcctcagcggagaacccgtctttacaggggcactgggcgacagcaattcagatcgcgactggtgaccaattgtgccagcggacgcccctgagcaaccaactcagagtaacgaaacatgatcacgagcactaacaaacgataagtgaagcgaacggcccacggctgcaacgactgcttcctcatcatacatctttcattatgag

SEQ ID NO: 65754 - DNA, 249 bp, Homo sapiens
cagagggggcggacaccccccaagacccccaactctgcagggattggactccgtgggcaggaacctgccctctggtcagggcaaggtcaaggaacagaggggccagtccagggaggcccagcagcgagaagccagcagcctctgcggcccgaacgttccagctgcaggggccaaggtcacagccgccatccacctctcccctcaagcaggagtgtggcccttgttactaggacaacccaagcctggact

SEQ ID NO: 65755 - DNA, 304 bp, Homo sapiens
gaatatgaacacttatccttgaaccctatcaataacatttttcacatatctcaatttttgtgtgtctttgtagttgtatgtgggccacttactaatattttagcaagtaataaaaatagaaacgtaaaggaatattggaaaaagtctaatggaaccagaaagttctagcatttttttcccattctgtagtaggtcatctggtttatttggtttggtgaccgcaagtctagaagactaaccctgaattgaatggtaacagacaggcagaatgacaatgtagtgttgcagtgcagagcagtacaga

SEQ ID NO: 65756 - DNA, 345 bp, Homo sapiens
ggattaagccaggtcccatccatactgagggaatgaggttacaaaagactagaaactgctaggttgacagaaagggattaattcatgggctagcgtcaggatgttgactaataacatattgatcgtatctgtaacatatgcagaatgtctgtcaggagcagatgcactttggaattgaagatggctaggatatctgacacgatcaaagtcagattaatattattaaggagctgcaagtgagctgccaattaccttagcaatcacagacattttctacacgtgcctgtgattgaccgtcctaaacagtagcagtacttgctgcttagagggaagtgacagatttgt

SEQ ID NO: 65757 - DNA, 858 bp, Homo sapiens
tttctgactgaattttatgaactcattctgaagaggctgacgattttactgtctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagtgagaattagtttctagtactctctgggcctgactcaggactatactgactcaatacagagcctgggcacttctgcgtttatcttggtcacaacatgaattattctttcccttgatctgggacagtcacagaaaccaga

SEQ ID NO: 65758 - DNA, 814 bp, Homo sapiens
atgggtggtaactccatgggtgccaactttggtttcgaagaaccttttctaaatttatttatttttctctagctagcattggatttggtgtctagtacagattctgggattccaagaaagtgctttaaatattgggatatttttactaatttaaagacctgtttcccataggagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgtaaaaaaaaagaa

SEQ ID NO: 65759 - DNA, 1361 bp, Homo sapiens
tttctgactgaattttatgaactcattctgaagaggctgacgattttactgtctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgtaaaaaaaaagaa

SEQ ID NO: 65760 - DNA, 444 bp, Homo sapiens
caccactctgagaagggtttcctctctggcctccccatagctccctgtgcatacctttatcatggtattattcatattgtgttctggttctcttttatatttttctactgctttccaatcctccaaagaattataagttatttagaggcaggagctgttgaatgaataaattaatgaatacaagaaaaagagtaaatatctaagagtttcctactccctttattagttcacaaacgtggtcaaattaatagtttaccaattataaaccatcataagctctatgcagaagctcgcttttgttctaaccgaatacactgttcttcaaagacacaaatgacattaaatgttttgcaaatgaacccactggagtgcaggaagaacattatattggaaaatattaaacaacctgaaacaaaaagcagatcatttcccaaccacaaattg

SEQ ID NO: 65761 - DNA, 138 bp, Homo sapiens
ccaggtcttctcattatgctgtgtttttagacatcttttctcctttgcttgaaacgtcattttctcctcttactccagcttctcctcagccaacttctatttgtgtttatgactcagcccaaatatcatcatggaatt

SEQ ID NO: 65762 - DNA, 122 bp, Homo sapiens
ttttatttcaaggcacatttaatttaatatcaagagtgcaatacaaaaggcccaaatacaatgaaggaacacatccccccattaacaccaacgacaatgttcttttaaacatgtgcctgttg

SEQ ID NO: 65763 - DNA, 228 bp, Homo sapiens
cttcctggtccccagtaccccctgtccacctctggcacatgctggcctagtgggcagcgattatggacttctcagccccaggctgtgctgctgtaatccctccacccccaagccattctccaaggcccagctccggggccacctcctgaaggcctggtcctatgccactgccctccagcaatagtacgggtcacctctggagcatgcatcccctgccctccacggagg

SEQ ID NO: 65764 - DNA, 430 bp, Homo sapiens
gcatactggaaaacatattttcttttcgaaagtattatatcaatagaacaatatcatagcaaccttatcagtgtgggtggtactattaataattttgagggtttaataggcatcaaataaagccactttaataggtctaaaaaaaataagactttgttaaaatgtacatttctttaactgctattaatgtttttctcatatacttgtgaatgatttatatttctctgtttaatggtctctcctttttaaactattaagggcctgagaattttctctcacatttgaatgaacactttcatggtatatgtaaatattttcctagtttattgttctttttagtttttcatagttaaaaaaatttttaatcttcatctggctgaatttatcaatattttctttgttcactgtcctttctttagacgttgatgta

SEQ ID NO: 65765 - DNA, 1714 bp, Homo sapiens
tgagagaatcattaacttaatttgactatctggtttgtggatgcgtttactctcatgtaagtcaacaacatcctgggattgggacacactttctgggcactgctggccagtcccaaaatggaacataaggaagtggttcttctacttctgttatttctgaagtcagcaccgactgagacagggccttctgtgcaggagtgctaccacagtaatggacagagttatcgaggcacatacttcaccactgtcacaggaagaacctgccaagcttggtcatctatgacgccacaccagcacagtagaaccccagaaaagtacccaaatgatggcttgatctcgaactactgcaggaatccggattgttcggcaggcccttggtgttatacgacggatcccaatgtcaggtgggagtactgcaacctgacacggtgctcagacgatgaagggactgtgttcgtgcctctgactgttatcccagttccaagcctagaggattcattcatacaagtggcttgatctccaactactgcaggaatccggattgttcggcaggcccttggtgttatacaacggatcccaaagtcaggtgggagtactgcaacctgacaggatgctcagacaagaatagggctgtggccgcgcctctgactattatcccggttccaagacgagaggatacttccaaacaagcactgattgatccaaggccttcaatgtaggagtgctaccatggaaatggacagagttatcgaggcacatacttcaccaccgtcacaggaagcacttgccaagcttggtcatctatgacaccacaccagcacagtaggacctcagaaaagtacccaaatgctgacttgatcatgaactactgcaggaatccagatcctgtggaaggcccttggtgttacacgatggatcccaaagtcagatgggagtactgcaacctgacacgatgctcagacacagaagggactgcagtcgtgcctctgactgttatcccggttccaagcctagaggatccttccaaaccagcaccaacagagccaaggccttgggagcagcagtgctaccacggtaatggacagagttatcgaggcacatacttcaccactgtcacaggaagaacctgccaagcttggtcatctatgacgccacatcagcacatggcctgaccaggaacactgcaggaatccagattctgggaaacaaccctggtgttacacaactgatccgtgtgtgaggtgggagtactgcaacctgacacaatgctcagaaacagaatcagtgtcctagagactcccactgttgttcccgttccaagcatggaggctcattctgaagcagcaccaactgagcaaacccctgtggtccggcagtgctaccatggtaatggacagagttatcaaggcacattctccaccactgtcacaggaaggacatgtcaatcttggtcatccatgacaccacaccggtcatcagaggaccccagaaaactacccaaatgaactctatgtttgggaatgggaaaggataccggggcaagaaggcaaccactgttactgggacgccacgccaagaatggactgcccaagagccccatagacacagcaggttcactccagggacaagtccacgggcaggtctggaaaaaaatgtagggacatggatgaagctggaaaccatcatcctcagcaaactatcgcaaggacaaaaa

SEQ ID NO: 65766 - DNA, 578 bp, Homo sapiens
ttttttttttgcggcaattgtatggtacttttaatgggaatatttcaaaggccctggttatgaccttgttacagcaaaacggagagggtgctgggtgcccctgcatattgtcccacctcttgtgacgtatatccttttggaatttccagtgacttgatcatgaactactgcaggaatccagatcctgtggaaggcccttggtgttacacgatggatcccaaagtcagatgggagtactgcaacctgacacgatgctcagacacagaagggactgcagtcgtgcctctgactgttatcccggttccaagcctagaggatccttccaaaccaggtaagaagtctgtggccagacatctccacacttggacactgggtagaaaagcctttgaaactcccattgttgcagaagccttcagtgctacgcacgtgctcacatgttggttgatggtctgtcatgttggaagaatcctcagggcactctgggggggagccagacgagtgatttttggtgcaacgtgagtgggctgtgtctttaggataggcacgaaccctccaggttggtggacttcaccactcac

SEQ ID NO: 65767 - DNA, 2195 bp, Homo sapiens
tgagagaatcattaacttaatttgactatctggtttgtggatgcgtttactctcatgtaagtcaacaacatcctgggattgggacacactttctgggcactgctggccagtcccaaaatggaacataaggaagtggttcttctacttctgttatttctgaagtcagcaccgactgagacagggccttctgtgcaggagtgctaccacagtaatggacagagttatcgaggcacatacttcaccactgtcacaggaagaacctgccaagcttggtcatctatgacgccacaccagcacagtagaaccccagaaaagtacccaaatgatggcttgatctcgaactactgcaggaatccggattgttcggcaggcccttggtgttatacgacggatcccaatgtcaggtgggagtactgcaacctgacacggtgctcagacgatgaagggactgtgttcgtgcctctgactgttatcccagttccaagcctagaggattcattcatacaagtggcttgatctccaactactgcaggaatccggattgttcggcaggcccttggtgttatacaacggatcccaaagtcaggtgggagtactgcaacctgacaggatgctcagacaagaatagggctgtggccgcgcctctgactattatcccggttccaagacgagaggatacttccaaacaagcactgattgatccaaggccttcaatgtaggagtgctaccatggaaatggacagagttatcgaggcacatacttcaccaccgtcacaggaagcacttgccaagcttggtcatctatgacaccacaccagcacagtaggacctcagaaaagtacccaaatgctgacttgatcatgaactactgcaggaatccagatcctgtggaaggcccttggtgttacacgatggatcccaaagtcagatgggagtactgcaacctgacacgatgctcagacacagaagggactgcagtcgtgcctctgactgttatcccggttccaagcctagaggatccttccaaaccagcaccaacagagccaaggccttgggagcagcagtgctaccacggtaatggacagagttatcgaggcacatacttcaccactgtcacaggaagaacctgccaagcttggtcatctatgacgccacatcagcacatggcctgaccaggaacactgcaggaatccagattctgggaaacaaccctggtgttacacaactgatccgtgtgtgaggtgggagtactgcaacctgacacaatgctcagaaacagaatcagtgtcctagagactcccactgttgttcccgttccaagcatggaggctcattctgaagcagcaccaactgagcaaacccctgtggtccggcagtgctaccatggtaatggacagagttatcaaggcacattctccaccactgtcacaggaaggacatgtcaatcttggtcatccatgacaccacaccggtcatcagaggaccccagaaaactacccaaatgatggcctgacaatgaactactgcaggaatccagatgccgatacaggcccttggtgttttaccacagaccccagcgtcaggtgggagtactgcaacctgacgcgatgctcagacagaagggactgtggtcgctcctccgactgttatccaggttccaagcctagaggctccttccgaacaagtaaaaagtctgtatccagacatctatgtgcttggacaacgggatgaaaagacatgaaaagccacactgatgcagaagcctttagtgctgcacgggagctcgagtgttggttgagggtctgccgtgaccaaggaagcctcaatgccgtccctgggaaagccagagctgtgatttttggcacaacttgcgagtgtagtgactttaggactggcgcaaaacctccagggtgctcaacttaaccactcaccttgttctaaaataggttatttcagtgtcccagtcaaattcctattctaacatgctgtcaactatgtgattctttccaagccaataaacatttccagtaatttcttaaaatagtgttcatggcagtcttcagcagtggcttctgactaatgtggcccctgattccgtcgtcctagagaaacctgacatgactgcattgattccatattgtcctgggtctatgtggctgtgcatatcatctgctttttgtttttgttttcgtttt

SEQ ID NO: 65768 - DNA, 1676 bp, Homo sapiens
tgagagaatcattaacttaatttgactatctggtttgtggatgcgtttactctcatgtaagtcaacaacatcctgggattgggacacactttctgggcactgctggccagtcccaaaatggaacataaggaagtggttcttctacttctgttatttctgaagtcagcaccgactgagacagggccttctgtgcaggagtgctaccacagtaatggacagagttatcgaggcacatacttcaccactgtcacaggaagaacctgccaagcttggtcatctatgacgccacaccagcacagtagaaccccagaaaagtacccaaatgacggcaggcccttggtgttatacgacggatcccaatgtcaggtgggagtactgcaacctgacacggtgctcagacgatgaagggactgtgttcgtgcctctgactgttatcccagttccaagcctagaggattcattcatacaagtggcttgatctccaactactgcaggaatccggattgttcggcaggcccttggtgttatacaacggatcccaaagtcaggtgggagtactgcaacctgacaggatgctcagacaagaatagggctgtggccgcgcctctgactattatcccggttccaagacgagaggatacttccaaacaagcactgattgatccaaggccttcaatgtaggagtgctaccatggaaatggacagagttatcgaggcacatacttcaccaccgtcacaggaagcacttgccaagcttggtcatctatgacaccacaccagcacagtaggacctcagaaaagtacccaaatgctgacttgatcatgaactactgcaggaatccagatcctgtggaaggcccttggtgttacacgatggatcccaaagtcagatgggagtactgcaacctgacacgatgctcagacacagaagggactgcagtcgtgcctctgactgttatcccggttccaagcctagaggatccttccaaaccagcaccaacagagccaaggccttgggagcagcagtgctaccacggtaatggacagagttatcgaggcacatacttcaccactgtcacaggaagaacctgccaagcttggtcatctatgacgccacatcagcacatggcctgaccaggaacactgcaggaatccagattctgggaaacaaccctggtgttacacaactgatccgtgtgtgaggtgggagtactgcaacctgacacaatgctcagaaacagaatcagtgtcctagagactcccactgttgttcccgttccaagcatggaggctcattctgaagcagcaccaactgagcaaacccctgtggtccggcagtgctaccatggtaatggacagagttatcaaggcacattctccaccactgtcacaggaaggacatgtcaatcttggtcatccatgacaccacaccggtcatcagaggaccccagaaaactacccaaatgaactctatgtttgggaatgggaaaggataccggggcaagaaggcaaccactgttactgggacgccacgccaagaatggactgcccaagagccccatagacacagcaggttcactccagggacaagtccacgggcaggtctggaaaaaaatgtagggacatggatgaagctggaaaccatcatcctcagcaaactatcgcaaggacaaaaa

SEQ ID NO: 65769 - DNA, 3767 bp, Homo sapiens
gcggaagacagggctggtgctgcaccggtcgctgcttccccagtccttttttggcctcctttctgacgcgacgcagaccccagttctggagagtctgtcactcgctccccgtggtgggagatcagaggcctggtgtccttgggagcggcgagcggtgctcggcgcaggatagaaagggagtgcgcgcccgagtcccccagatccctgggaacccgcgccaccctcccgcccctgcccatccccggccgcgctgtcagtctccattagcgctaacaggctccagacggagcgggccgggcgctgggttaatgcaatcggcgcgttacctggggcgcaggctacattaccagcccggcccccgccaggcacggccagaaccaggcgcaaggcaccagggatcccctcgccgccggacacagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcaggatcttgggaaaaaataaagaagccgctgcattcgcacgtcaaga

SEQ ID NO: 65770 - DNA, 3900 bp, Homo sapiens
gcggaagacagggctggtgctgcaccggtcgctgcttccccagtccttttttggcctcctttctgacgcgacgcagaccccagttctggagagtctgtcactcgctccccgtggtgggagatcagaggcctggtgtccttgggagcggcgagcggtgctcggcgcaggatagaaagggagtgcgcgcccgagtcccccagatccctgggaacccgcgccaccctcccgcccctgcccatccccggccgcgctgtcagtctccattagcgctaacaggctccagacggagcgggccgggcgctgggttaatgcaatcggcgcgttacctggggcgcaggctacattaccagcccggcccccgccaggcacggccagaaccagtcagcccgcgccctgccggccgccccgcgcctccagctcttccccgggccccgcccgaacgccacacggcggagcccagccccagcccgcgccctagagcctgccaaggcgccgccggtcgggggccggcagggcgcaaggcaccagggatcccctcgccgccggacacagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcaggatcttgggaaaaaataaagaagccgctgcattcgcacgtcaaga

SEQ ID NO: 65771 - DNA, 3765 bp, Homo sapiens
gcggaagacagggctggtgctgcaccggtcgctgcttccccagtccttttttggcctcctttctgacgcgacgcagaccccagttctggagagtctgtcactcgctccccgtggtgggagatcagaggcctggtgtccttgggagcggcgagcggtgctcggcgcaggatagaaagggagtgcgcgcccgagtcccccagatccctgggaacccgcgccaccctcccgcccctgcccatccccggccgcgctgtcagtctccattagcgctaacaggctccagacggagcgggccgggcgctgggttaatgcaatcggcgcgttacctggggcgcaggctacattaccagcccggcccccgccaggcacggccagaaccagtcagcccgcgccctgccggccgccccgcgcctccagctcttccccgggccccgcccgaacgccacacggcggagcccagccccagcccgcgccctagagcctgccaaggcgccgccggtcgggggccggcagggcgcaaggcaccagggatcccctcgccgccggacacagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcaggatcttgggaaaaaataaagaagccgctgcattcgcacgtcaaga

SEQ ID NO: 65772 - DNA, 2848 bp, Homo sapiens
  misc_feature (1)..(1): n is a, c, g, or t
naaaagaaaaacaaaaaatcggctaggacgaggctggtgttaatcggacgagcctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcaggatcttgggaaaaaataaagaagccgctgcattcgcacgtcaaga

SEQ ID NO: 65773 - DNA, 3167 bp, Homo sapiens
gtcagaagtctccaactcttgagttccggcgtgccccaacctctgtttccaaatttttccagcggacgcgcgctcttttctgggaaccctgcgtccgctcagcgcgcgctcatcccagtgtctaaggcgctcccgggtggtcttgggagttgcaagtagggaggaacggccgggtaaccacctcttttccctttatccaagcagagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaagatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcaggatcttgggaaaaaataaagaagccgctgcattcgcacgtcaaga

SEQ ID NO: 65774 - DNA, 3554 bp, Homo sapiens
gtcagaagtctccaactcttgagttccggcgtgccccaacctctgtttccaaatttttccagcggacgcgcgctcttttctgggaaccctgcgtccgctcagcgcgcgctcatcccagtgtctaaggcgctcccgggtggtcttgggagttgcaagtagggaggaacggccgggtaaccacctcttttccctttatccaagcagagcctcggcgtgcccccaggaccggtaaagttcctctcgccagccgcatccatgcttctggcgcggatgaacccgcaggtgcagcccgagaacaacggggcggacacgggtccagagcagccccttcgggcgcgcaaaactgcggagctgctggtggtgaaggagcgcaacggcgtccagtgcctgctggcgccccgcgacggcgacgcgcagccccgggagacctggggcaagaagatcgacttcctgctgtccgtagtcggcttcgcagtggacctggccaacgtgtggcgcttcccctacctctgctacaagaacggcggcggtgccttcttgatcccgtacacactgttccttatcatcgcggggatgcccctgttctacatggagctggctctgggacagtacaaccgggagggggctgccaccgtttggaaaatctgcccattcttcaaaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcaggatcttgggaaaaaataaagaagccgctgcattcgcacgtcaaga

SEQ ID NO: 65775 - DNA, 3164 bp, Homo sapiens
atctaggttgtgtgctccttatgagaatctaactaacgcctgatgacctgaggtggaacggtttcatcttgaaactacccccaccccaaaatctgtggaaaaattgtcttccatgcgacaggtcactggtgctgaaaaggttggggaccgctgttctgcaggaaacgagagacagagggaatgggagtgcagtggtggagccacacccaaggagaggtggctgtggggctgggcctgggagactcctaccttaccccctgtccctgcccaggcgttggctatgctgtcatcctgatcgccctgtacgttggcttctactacaacgtcatcatcgcctggtcactctactacctcttctcctccttcaccctcaacctgccctggaccgactgtggccacacctggaacagccccaactgtaccgaccccaagctcctcaatggctccgtgcttggcaaccacaccaagtactccaagtacaagttcacgccggcagccgagttttatgagcgtggtgtcctgcaccttcacgagagcagcgggattcatgacatcggcctgccccagtggcagctcttgctctgtctgatggtcgtcgtcatcgtcttgtattttagcctctggaaaggggtgaagacatcaggaaaggtggtgtggatcacagccacgctgccttacttcgtgctgttcgtgctcctggtccatggcgtcacgctgcccggagcctccaatggcatcaatgcctacctgcacatcgacttctaccgcttgaaagaggccacggtatggattgatgccgcaactcagatatttttttccttgggggctggatttggagtattgattgcatttgccagttacaacaaatttgacaacaactgttacagggatgccctgctgaccagcagcatcaactgtatcaccagcttcgtctctgggttcgccatcttctccatccttggttacatggcccatgaacacaaggtcaacattgaggatgtggccacagaaggagctggcctagtgttcatcctgtatccagaggccatttctaccctgtctggatctacattctgggctgttgtgtttttcgtcatgctcctggcgctgggccttgacagctcaatgggaggcatggaggctgtcatcacgggcctggcagatgacttccaggtcctgaagcgacaccggaaactcttcacatttggcgtcaccttcagcactttccttctcgccctgttctgcataaccaagggtggaatttacgtcttgaccctcctggacacctttgctgcgggcacctccatcctttttgctgtcctcatggaagccatcggagtttcctggttttatggagtggacaggttcagcaacgacatccagcagatgatggggttcaggccgggtctatactggagactgtgctggaagttcgtcagtcctgccttcctcctgttcgtggttgtggtcagcatcatcaacttcaagccactcacctacgacgactacatcttcccgccctgggccaactgggtggggtggggcatcgccctgtcctccatggtcctggtgcccatctacgtcatctataagttcctcagcacgcagggctctctttgggagagactggcctatggcatcacgccagagaacgagcaccacctggtggctcagagggacatcagacagttccagttgcaacactggctggccatctgagcctgcctggaggagaaggaggaacccccatgccaatgtccaggtcacaggcatccgctgcgctcccacctcggacaccatcttgggattcctcccctggaagttgtcctttctgatcctctcttcttttcccatttacaaatgatttcgtgactgtagtttttgttcaccttctgtgcatctggcctgggggctgttagctcagaggagaggagcaaacaggaaaatgacttctgttctgtccccgctgttttgggggaagtctctcccactttgggatcctgctgaagctaggttcatgaggtcggaaatccccaccacatttgcctagactttgggcacaggagttcttagtccaccaaatcagagagaggatgggcttttgatcagatacccctcccaaaaaaaaaaaaaaactaaaactaaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcaggatcttgggaaaaaataaagaagccgctgcattcgcacgtcaaga

SEQ ID NO: 65776 - DNA, 6266 bp, Homo sapiens
  misc_feature (141)..(141): n is a, c, g, or t
  misc_feature (412)..(412): n is a, c, g, or t
  misc_feature (1310)..(1310): n is a, c, g, or t
  misc_feature (2260)..(2260): n is a, c, g, or t
  misc_feature (2918)..(2918): n is a, c, g, or t
  misc_feature (3734)..(3734): n is a, c, g, or t
  misc_feature (4342)..(4342): n is a, c, g, or t
  misc_feature (5361)..(5361): n is a, c, g, or t
  misc_feature (5394)..(5394): n is a, c, g, or t
aaaggatcgatgagaagggggcattccagttgagagcagtaaagcataaatttcatgaggcaagacagtttgagttttaggaaactgaaagtcaatgtgttgtaatttttaaattaattgcatgggggtgctagatgaggntatgaaattggtaaacagaggtcagaaccctcagatgatgcatttcaaagttgagagagaaaaccctttaatggaaaactgaactatagtgtaaagcccaaaattaaggcctaatactatatactgccaggcaggctaagagctccccttctaatgctgcttgcctaagacagggtcccatagctgtagtgtatcccttatcttttttcctatctattggaagagggggctcaggcaaaacctctgtctcctctttgttattttggcccgntgatagtggggctgagggataaggaggcagtaaggtaggtgatggttcctcttccctcccctttttaggctcttctgtgtataacgggaccaaagccaccctaactaaagcccataatgttaaagatgttactgggacccgttgcccttgcacatgatgctgtttaagatttctcccacttgttcccagagctctacatctagcataccttcttctgggaaccatgggttatgagatacaacagtttgcattaggtcccttaattgagcctgtgaaaccaagcctccactagctttaagcagctgtttcaatacttttatatactgtttcttttgagctgataactgttgtcccatgatgaaaccctagcctgaacaattccctcgaacttggaaatcctgagcaggcaccgatgacttactgatttactgacttactgactgcacagtctccttacctttgttttggagggttccttcatgatttgttgcagcattcctctcacagggcaccacctgccggggtctgacccgcagaccatggccaaatgatggatgaaagaatgcactcagacacagacatccagtgaaagagtgggctaggggaccggccacgcacagaccccacggagggtgctgtaaagagtcagcagctgcagctgctggtgctgcaggcatttattcagcacagatttaatgagaaaggctttgagacaacacacttgtggataattaacatggtggcccctctggagagagcagtcctgcacatggatgattaaaggccaggttccgaggcctaagtaaattaacttatctagatcagtttctttacatccccttgttatctaacctaagctcttaagagaactcagctgccttcagccaaattttctttngaagctttgcaaacccctggctttccaagaaggtttgcatctttctacaatttttcccaccaccctgactgatctcctacaatatattgccttcgatttttcaaatgacctaactagaaattcctctctacactatgcacttgcagattaagtcccttagccaaacaactgtctttactaagagaaccaggcacagatcttgttttctttccctgacagccttcagaattattcacacaagccaatcacgtcttcccatgagaactagaggtcacctctccctcttgatctacaaatcatgcctcccagagaccttattcattcactctgttcctgagtacaacccttgtgtgaccctgtgtggtatgtggtatactgctaccctgggctgtgagtatatgtgattaataaactgctgttgacctcatctgtacagtgcccagtatcatgtgtttgaataccacataaccataatatggaaattccttcctcaccaataaacaggacaccactaaagcatgcttttatgaattactttgagatcatagataatccagaaagaaatctttacatttagactagtggcttacacaacagaagtttattttctcacagttctggaggctgtaagtccaagatcaaggtgccagcagggttggtttcctctgaggcctctctcagcttgcagaaggctgccctcttgcagcctcttcacattgttgtccttttgtgtgtgtgcatccccggtgtttcctagtgtgtcctaacctcttcttttcaggactccagtcagattttataaaagtactctaatggcctcattttaactaatcacctgtttaaagaccttatctccaaatagagtcacattctgaggtactgggggttaggacttgagcctgtgaatttgaggttgggggcaaaattaatttcataatagacaggaattngagatacatttgctcttatctcagtacagtagaacacaatgcacaagctacgttttctatgcaaattgtctccagggagtttccctaaattaagagtgagatgcacgaaagccactgtgttggcttttttttttctttttacctagaattggaagaaagaactagatcctactaggaaaagacattctaatgagattatcctgagtgtaatttggcagattctaagggagggctagattttggtggggaagaaatgaatgaaaatatacggggtttggatggaagtgtagctgggatgcactgaaggagttagtccttaacaaaattctagaagatttgaattgtatccagatggggaagaacccccaacatccaaattaaataatggattccctagtggggaaaatctaattttacttgctacagcaaatttttggatgatttggtgttgtttgagagcattgcattttctctgacatatcctggatttttaaaaaatctcagataagaagataatcataaataatcataaataaatgtcatttattaaacacctaacatttgccagtgactgtgaaagattaagtcttagtgatgaagagaattagattagtgtgtgttttctgacagccacctcctatcccaggacctctgcctngttcttcagcttccccatttcacatcactccacttggacacagacctattctgctcaagatttttcaggagtgtggcatttcccaggaagcttttcattaagagacaggagccaaggatgtcagggccttgctgcaaagggctctcattgaagtaaggctctaagagaagtcaaattgggaatcctctgtgagactgagggaactacccactccagaacagagaaggcaccacagatgtcacccctgcagtcagccttgagaacactttcactgggaatatgggtaggactcacttccacccgagggtcacagaaaggtgagggacgtggcctaaggcaggccaccttagcacacgtgcaagctagcgaggggtcttaggctcaggcagaagtcaaggtgagaatacctaatgagagtaagagaaccacccacctcagaagcatgccccgggccttctcccccaaaaagcctgacccctgttctcagtcttgggaggcactgaacagagtagacaggatgagatgtgtgctcacttctgcctctagggcctcggggaggtgagggtcttagtaaaagtacgtgaacccagagcagctgagggagaaggagcaaaccctagcagcagtcaaggtgaggaaggttaggtggagaatcccatcaagctcttgtttgcagctccctgagtgcccgaacatggatgtcaagtatatgtgagctctcctttcctacttgatgataccgggagctgaggtccttggcctggagtgggcaggggacagagggctaaggtcagcaaaggaaggagtaccatgccnttcagggaatcaacagcagaagcctgcgtgatttctgagggaccactgatctcagaagagtaccgtagcacaaagcctgctcctgccatcaaacttaggaagccctgggccaggctgacttcttcaagggggtctcagagatgtgagggccttggtctaagggaagagtactcaagtcagcaaagaaaagcagccaaggtgcagccaggaatcaaagtaagtgccctacatgaggactgaaggaacccctgctctactggcaccctgggatgcctgtgcactgattacatgacttgcactcatttcctgctgtggtatgggggcgtttattggtaatgatggtgagggattttgtctaaagtagatggcctgaggtctgcagtaggaggatttccaggtattactaggaattaaggtgaagacatggtgtcggaggggaacaccaaattcatcccctattctcagccttggaagaccacaggcaggtgaggtggtacccatatcttactagagagtctcaggagaatctggtgggaatagagaagccctgggccatgccaagagacaaaggaagggttgggaggaccacccaccattgaatagataanaaagcatctgtgccccacccttgcactcagtacttaaaggaccagggcaggactatcaggctgaggctcctccccacttctttatatatataaaatctaaggcagatgaaatctttggtgtatgattgtagccaccagtcagcaaaagggaagtcttccaggaactacctagagatcaggtggattcctagaatgagaactgaagacccaagcatctcatgacagagagacctccatatagctcccagttgggtgccctctgacagagatggtggactgagatcctccttcactttatcgtctggggtctcagggaggtgctggctttggtttgaggtgtcaacttcagagcagcagaagggaggggaaccagggcctgccaacaattgatatgatgattacgattatgaacttagacccccacactccataacagagaacccccattaccagcccctgccaccatctcagtacacctaaggcagggttggcaggctgcagcctaaaactcactctaactttatccacagggttctcagtggagaggctgaccaggagaacaggagctccatgggttcctaaagcagtgctcttggaaacctgtggctgtggcctttgttaaagccatggtagtctctccctgctgctggtgctcacaccatctcattctccctccttcaggtgcccacattgccagccatcctgtccacactttttcctactctgcctaaccagagtcatcatgtcttggtatcagaaaagtaagttccatgtccataagaaatgtcaccagactcaaagtaagactcggggtaatgggggtactcaggcaatagtagtggcagcagaagagtctcctccctcctcacctcttctttgtggaggtgttactgagagcctacctactgctgggtcatgtagcactttgaaggagcctcagaaagcctcatccaccactacttaaataggcattttttgcactagatctgataaatttcccaatggccaagataaggaanagaaaagcacggctgaggccccaccttccagtnagaactcatgcagagaccctcaaaccaggaaagctgggttgttggagcagttcctgctctacaagtataaaatgaaacagcccattacaaaggaagatatgctgaaggttgtcaactaaaaataccgaaatcagtatgctgagatcctcagaagaacttctgagtgcattaaggttgcctttacgttaatatgaaggaagtcaattcaacccatcactcatatgaccttgttatgaccttgtaaagctaaaagttcccaacaatgggagggtgtttggtggcagggggttacccaagactggtctcctgataaatcttctgagtgtgatcttcataaagagcaactgtgccattggggaagacatctggaaattcctagatatgatgtgaacatatgctgggaggaagcactacactatggagagctcaagaagctcatcactcaggatttgatgaggctaaaaagtacctggagtactgctcaacagtgatcctgcacgctatgaattcctttgggatttaagagcacatcttgaaaccagtaagatgaaagtcctgaagttttggcaaaggtcagtgatactgtccctagtgtctccacatcccattatgaagaggctttgtgagatgaggaagagagagcccaagccatagatgcagccatgcctggcgctactgccaaagctagtgcagtttccagagccatatgtccagcatatcttcctacctctactgaggactgaggacttttgatcattcagataagaagatacgacaccacaggaaagattttcttgaaaatttgaaataatcacacagtaaaataagtagggtaatacaatggagaaaaaaataaaacacgattaatcctt

SEQ ID NO: 65777 - DNA, 545 bp, Homo sapiens
tgatagagtgttctgaggctacaaggaaagaagaggtcggccacattttattttaatgcatttccattaaagagttcataaattgttcttttgagaagactcttaagagattaagtttaggaaatattgaaaatggaggaaaacctcccttttaaatatgatctcctgtgttccatgatccatttaacatcaaaccattcttcacttgtcttaacacttttcttaacagtgagacacgcatcaaagtgaattcaaaacaatgttaagagttttaagatacctaatatagctgaaagctatttccttgttatttaataaacgtctgattttaggcaaatcccattcttccttatttttggacatcaaattgtagttttacatttatttgtttagggttatccacaacatgaaacacacacaactcattaaaagtaaattatattttcagaagtccatcagctaatgccaggtaaactgtaccagcaactaagggcagtggacataatggtttggagaataatgtcatgttggaggacaaggttgac

SEQ ID NO: 65778 - DNA, 657 bp, Homo sapiens
tgattacttcaagttctaaaaaacttccaagcaatctcaaataatttgcatagttatattcactctaacatgatcaaactgtcacaaatcatgatgtattagagagtaaaagttaaaactgagcagggtctttttaacatatgttcaaacaaatatagctctattataaaactgttaaaacccatgtagttcattgtcagataaactaaaaataagaaaatatacaaacaaagaatggacagacagctgtgagcaaaggagaaaaagaaaattaatcatctcaaacactctatttacttctattaatagaatgattataacaaaaaaatataaaatttttctacccatcacacagattcttccacttaataaaatccatcacctacctattacataaacattaaaaaaaaacagctaaacgaagtaaagactaaaaattcaaattccctctaaccttatcacccctccctctttgtgcctccaaatgggtatttgaagtcattcttcataaaatgccacttctaactaggtgactgtatacatttttcatctaaccaggacacttttttaaagacctcaccgttaataattacaacagaacagcagaaataagccaaactatcctaagtgggaagtatgatcaccctgtattaaccc

SEQ ID NO: 65779 - DNA, 763 bp, Homo sapiens
aaatactgtggcccatgggtcttctggggtgctctttatccctcccccacccccacccccacccatctctggtggggctcatggtctcccgtgatgtcccagtgtctgcagatggttgagaaggtgtccaagggaggcccaggtgcaatcctccacaccacacctacaggtgaaggaggcagctgccttccaagcctggagaaaaccccaggggaggctccgattgcctggctcaggtctcagtttatccttgagccaatcactgcagccaggggcatctgtgctctgagcacatgggtttcagaccctcccctgagttaggaggaggagttccagtgtcctctcctgctcttagagagtgcaggtgtgggcctggggggccttcagcaacccagaccctgccatccagcctgggttcccggccccatctctctctctgaggtccagagaggccctcagggtggcaagagctgatccgctcacaccctgctagagtcagccagggaacctcactgggtcccacgctgggagcaggtcctacagctgttcttgtgtgtcctagtcccgcttgtggcagtgcctcaaatctgatctcctcaggctgaggtgggtccaaggtcctgttctcccgcctcgtcctccacagagtgggagctttccactgggctgaacatggccacgcacgtccctagcaccccggctcctcgtacctgacccctggggcgtgcttttgtgcttctggatccttctcgatgtagcagag

SEQ ID NO: 65780 - DNA, 543 bp, Homo sapiens
aagaaaaaacccagctggctaaaccggagccacaagctcattcttgaagctgagggagtgcgtccacccccatttgaatcatatggactgatggggagatccccaaagaaaacttaaagaactattagcagaagaagagaaaaacgaaagtacgtcagctaaaatagcaaaggtacatttcagttgatgaacacgcccagcatttctgaaaagcattttgccaagtacctatacaactcctatgcatctctgtaagcctcgctcaagaggccctcccccaaaaagcacccctatcatcacccttcaactttctccttgctctgaattccaatggcacacaatttggcagcctgtcttctctctcccagagaggtcttcagagatgaggaccatatatcaccctcctcttatactgtctgtccaaagcaatgtcagctggaacaaatcagaacacataatgtgcacctggaaaacaagcctctttctaaacagggaggtgaatttcaactcaaactgaggacaggctttccaatatgcagagct

SEQ ID NO: 65781 - DNA, 715 bp, Homo sapiens
ggatttgacgggaatggggctggggactgtcatgttgaagcccggtggagatgtgggacagggacctcgtttgttccagagcctgttccaaccctccctggcttttgtggcatgttttctatgccgtttgctgcaaggatgcgttgggcatggagtaacattcccgagaccgtcctgcagtactgcacgtgtgcgtgtctgtgctttggtttgtctgtgtgtctaccttgttttagagtaaaaaagtgaatctgaggccagatcatcagtctgcacctgcctctccagcagtccctgcatttcctcacctataaaatgggaaggggaacactccttatggagctggttcaagtattgagcgagagaccgggactacaagtgttttctaacacaggggcatgaattcagccgtggcggcggcagcttgttaggagagcgatcagcctaggggctgatggggtggccaggcgtcgggatggcatccagtcttctctgtctgcatgctggagtcatgtgagagatttataacagaatagggatgctgggttccatctcctgaaattctgtgtcattggtctgaggagtgtcctgggcatctggacacgggaaagctccccagcagggtctcctgtgcagccaaggttgaagctgcttcctagtccatttcttgctcttcagatggatttgtgcttctttaggtaggactcatcctagt

SEQ ID NO: 65782 - DNA, 661 bp, Homo sapiens
ggatttgacgggaatggggctggggactgtcatgttgaagcccggtggagatgtgggacagggacctcgtttgttccagagcctgttccaaccctccctggcttttgtggcatgttttctatgccgtttgctgcaaggatgcgttgggcatggagtaacattcccgagaccgtcctgcagtactgcacgtgtgcgtgtctgtgctttggtttgtctgtgtgtctaccttgttttagagtaaaaaagtgaatctgaggccagatcatcagtctgcacctgcctctccagcagtccctgcatttcctcacctatccgggactacaagtgttttctaacacaggggcatgaattcagccgtggcggcggcagcttgttaggagagcgatcagcctaggggctgatggggtggccaggcgtcgggatggcatccagtcttctctgtctgcatgctggagtcatgtgagagatttataacagaatagggatgctgggttccatctcctgaaattctgtgtcattggtctgaggagtgtcctgggcatctggacacgggaaagctccccagcagggtctcctgtgcagccaaggttgaagctgcttcctagtccatttcttgctcttcagatggatttgtgcttctttaggtaggactcatcctagt

SEQ ID NO: 65783 - DNA, 449 bp, Homo sapiens
ctgggtgaatattgtaattgcccacaaccccgaattcactttttccctccagtatgataaaacagattgattcccttttaaagcaataccctttcttctctcccatcttgtcggtatcagagataatggataggtgagaaaaaattaaagaagcttctggattcattgtaatggggacctaaccatcacactatgcagcagcaaatgggatggtctggaaagcagaccagaaccttgtctggtaactttgcttctaatgtctgtctgtgtttcctaaactgaggcctaactcttgactttttgacagtggtgctcataagaaagtttggggctgggcacggtcactcatgcctgtaatgtcagcactttgggaggctaatgcaggaggatcacttgagtctaggagttcaagaccagcttgaacaacatagggagaccctgtctgtatt

SEQ ID NO: 65784 - DNA, 129 bp, Homo sapiens
aactgtgagacctcttgggaccattggtaggctttagcttttactctgagtgacatagggagccattgcaggggttagtttttctgtgtttgagacagagccttgctgtgtcgcccaggctggagtgca

SEQ ID NO: 65785 - DNA, 343 bp, Homo sapiens
gcatgaaaaccgataatgtcagaatatgaaagaagtagtaggtagaactgtcctgaatattgtcagtcatagcagtgtaggatggagattaccagaggctgaaggatgggaacattgggcagacagatgttggtcaaaaggtacaaaatttcagttaggcaggaggaataaattcaagagatctatcttatatcaaggtagctatgactaatagcaatgtattgtatgcttgaaaattgccgagggtagattttaagtgttcttatcacaaaaaaaatgattaatacatatgttaattagtttaatttagccaatacacaatgtgtatatatatatatatatt

SEQ ID NO: 65786 - DNA, 1046 bp, Homo sapiens
atcttaacacaattgaggtgtgtggtcatagcaacactaccatgtcaggaatgtgtgccctctgagtacatttcactggtatgaatagttatcatctgtgcatgcttgctcatttattcaataagcacttgctgagcccttcctcctctggtagaagtattagagtctcagaaaaagacgctgctgcctgtctttataacatatgttggcaaatgttaatgcaaagtagaatgtgccatgtattttggatattctgtttttttttttatttttattttccctcccactgttctcatcaggtggatagtctgaaaatggagggatcagttttgacctcagggggcctgcgagtagctctaagcccagggcagaggtgcatatgcagtatgcagagaaagctaagcaggtggcatttacgctgaatcttgaattattggtaaatgtttaacaggtcagatgttctcttagaaagttatctgttccttaccatctgagggccaatcttagtggttctgccattgtttccgttttattgaaattccttattttcccctttgcccattttctaacatcatgttttaatatcagtgtactgaatggccatggtttgcagtaacttcttagaaatgcttggtaaatacacctggaatttttttttccttccaaaataatcccagaaaaaacatctacatgaactcaaagtgaatatttagaagctttttcaaaaaatttatagagccgagtacagtgggattatggcaacctataatcccagctacctgggaggcttaggcaggagggttgcttgagcccaggagttcaagacaagcctgggcaacatagcaagaccctgtctcaaaaaaaaagttacagataagagttcttatattttaagcatttaggttattagagatattttttcttattataaatagttttatgactgttatttaagactgtttactctttaaattttttttttctttatcgtgatatgtgcagctacactggtacgaacattaaccctcacctcagtattcacatgg

SEQ ID NO: 65787 - DNA, 302 bp, Homo sapiens
aaaagggagaaaggaggaaaagggattgaaaggaggaaaagggattgaaaggaggaaaaggaagaaaaatatgagattattaatgtgaagctcttagtactgtgcttggcatttattaagcattttataaaacgtattattattgccactgctattattattaacattaaaacatacctgttttctatgggatttctttaggacctgacttttaaagatcttaagctatttagattctggagtcaggctctactgtgttctttgctaactgtgtgtgcatgaaaaaataacttaatctttct

SEQ ID NO: 65788 - DNA, 772 bp, Homo sapiens
gctgggatggagacaactatttactatgtctgtgacccctcccttctgcctccctccccttcctctctttcctgtcctctatccttgctgcccctcccccaatatgtcccccaaacccaggggctcagtatttatttatttatataattgcagggtgactgggggcctctctcggcaactcgtagagagcctttggataatggcagggtggggaatgggcgaggagtctttgggaagagcaggggcctgaactttcaactcctttctggcctcttgtcccactgcttccaccatcaccttccaaatccagggctgcactagggcaaggtgaccaccctacttggtaaagacctgattggcgcagcccattctggtgtgggtgtctttcaccacccagaatgaccaggttggaatgggggtgggtgaagttggagggggtggcaagtacaaggcaagggtgcccaggaaccggcatccagaaatcagccctggagtagacctgcctttcctccatccttaccaagttagcctccctttcagttccgtctgacccctgtgttggtagccccttccttcccttcctgtaccccctccgtctcttctcgtggtagcgggttagtgtttcagtgttcttaactccaatctgcttgttcattgtacaatgtgcttcttttaaggccccatttttgtaacttgagtgtgtcattcatctgaacaacaaacatcaaaaaataaaaaattaaaaactgtacagagagaaatgataaaaaaa

SEQ ID NO: 65789 - DNA, 500 bp, Homo sapiens
atacaagagtatgattagccagtataaagtggtaaggaagggtaacaaaagtaaggaataaagaagaggactgatgaaggggaatgccaaatgatgagaagtgggtgttctgttgacaacccaaaaatgaccaggttggaatgggggtgggtgaagttggagggggtggcaagtacaaggcaagggtgcccaggaaccggcatccagaaatcagccctggagtagacctgcctttcctccatccttaccaagttagcctccctttcagttccgtctgacccctgtgttggtagccccttccttcccttcctgtaccccctccgtctcttctcgtggtagcgggttagtgtttcagtgttcttaactccaatctgcttgttcattgtacaatgtgcttcttttaaggccccatttttgtaacttgagtgtgtcattcatctgaacaacaaacatcaaaaaataaaaaattaaaaactgtacagagagaaatgataaaaaaa

SEQ ID NO: 65790 - DNA, 722 bp, Homo sapiens
gctgggatggagacaactatttactatgtctgtgacccctcccttctgcctccctccccttcctctctttcctgtcctctatccttgctgcccctcccccaatatgtcccccaaacccaggggctcagtatttatttatttatataattgcagggtgactgggggcctctctcggcaactcgtagagagcctttggataatggcagggtggggaatgggcgaggagtctttgggaagagcaggggcctgaactttcaactcctttctggcctcttgtcccactgcttccaccatcaccttccaaatccagggctgcactagggcaaggtgaccaccctacttggtaaagacctgattggcgcagcccattctggtgtgggtgtctttcaccacccagaatgaccaggttggaatgggggtgggtgaagttggagggggtggcaagtacaaggcaagggtgcccaggaaccggcatccagaaatcagccctggagtagacctgcctttcctccatccttaccaagttagcctccctttcagttccgtctcttctcgtggtagcgggttagtgtttcagtgttcttaactccaatctgcttgttcattgtacaatgtgcttcttttaaggccccatttttgtaacttgagtgtgtcattcatctgaacaacaaacatcaaaaaataaaaaattaaaaactgtacagagagaaatgataaaaaaa

SEQ ID NO: 65791 - DNA, 297 bp, Homo sapiens
tgtcatctgggcctgttggtgcggcacatggatctaggtgctgtcacgggctgtcagttgtggcacgtcctggcagggcctggctggcccagcctctgctcatgcagtattcatctgcagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaaggggcatgtaacag

SEQ ID NO: 65792 - DNA, 2230 bp, Homo sapiens
cccgattcggactctgatcaccggctcaatggatgccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaaggggcatgtaacag

SEQ ID NO: 65793 - DNA, 2442 bp, Homo sapiens
cccgattcggactctgatcaccggctcaatggatgccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcggtatactagtagcaccaggatctccaagggagacagagaaggggcaatacttggagcatctggggaatgatatggctaaggatagcacagagaggccagataatgctagggcctgcagatagaagatcctgaatgtctgggttggtctttgctgggaggtatggaattgaccttgggatctgattcttcctgaccttctctcttccactcagggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaaggggcatgtaacag

SEQ ID NO: 65794 - DNA, 2178 bp, Homo sapiens
cccgattcggactctgatcaccggctcaatggatgccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggtaagttctgttgctgagaggctgggttttaggatcagattgatacgagtagtat

SEQ ID NO: 65795 - DNA, 1616 bp, Homo sapiens
ctgtaagggtaaagggggatgatgtatgtgaaagtgctttggaaagcacagagcactgtataaaaggtactcaaggtggtaatagtactaccaactctccctagctgtccccttccccactttgtgctcctccatcaaagggaaaacccaacccctttgattcctgatctcatgagcacaaataacttcctcagttctcagggtctgtacctcaatatgcctataatccattccaggactaacggtgcttcctcttcctgccctttcagctgtgctgcttttggcattcacctatgaggagcgggttggagtgggacatgggaatggcctttcctgagtaactccttcccatttgctcctcagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaaggggcatgtaacag

SEQ ID NO: 65796 - DNA, 871 bp, Homo sapiens
atattactctagactgggttcaagggtttgatgagggttgatgagtcatcgaaacctgtagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaaggggcatgtaacag

SEQ ID NO: 65797 - DNA, 1050 bp, Homo sapiens
tcctgcttcagcctccggagtagctgggattacaggcgcccgccacacctggataactgttacacttttagtagagatggggtttcaccatgttggccaggctggtctcaaactcctgacctcaggtgatccgcctgcctcagcttcccaaagtgctgggattacaggtgtgagccatcatgctcggcctgactgcagccattttctgacttccctctgtactcctcttatggctctattccttttttttttatggagtctcgctctgttgcccatactggagtgcagtagcgtgaccttggctcaccgtgacctccacgttccaggtttaagttcttctgtctcagcctcccagatagctgggactttaggcgtgcaccaccacgcccagctaatttttttttgtctttttagtagagatggggtttcactatgttggccaggctggtctcaaagtcccgacctcaggtgatccacccgccttggcctcccaaagtgctgggattataggtgtgagccaccgcgcccggccatggaatgtattctcttttatgtctctacctcctacatcttatctccaggttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaaggggcatgtaacag

SEQ ID NO: 65798 - DNA, 1517 bp, Homo sapiens
cccgattcggactctgatcaccggctcaatggatgccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatgggtacagtaaggggagccagtcaaggatgggtgggggtggggccctgcaatggaactgttcaggtggcatacaataaaagtctttagacagctttctgcatgtgccttggtgggattgaggtaggagacctgtggttgtgagatcggagcatgaaggtcaggacttggaagtgacccccccctccctttattccccactacagggagcctcgagaatttgcccatgaggccgaatgcttctcctgccacccggaatgccaacccatggagggcactgccacatgcaatggctcggtatactagtagcaccaggatctccaagggagacagagaaggggcaatacttggagcatctggggaatgatatggctaaggatagcacagagaggccagataatgctagggcctgcagatagaagatcctgaatgtctgggttggtctttgctgggaggtatggaattgaccttgggatctgattcttcctgaccttctctcttccactcagggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagatttgatccctttcttcaaggaagtagtgtggtcccctagaagaacactggtcagagaaatgggaggcatgcattctagtcctgattttgccattaatttgccacatgactttgaagaagttac

SEQ ID NO: 65799 - DNA, 404 bp, Homo sapiens
gtcagtgatgggataataaggagagggggtcaggtggaagggtaggagcacagaactagagtgagggaagcagaaagaagagagaggctgtgattcaagaatcactcccagctggccgggcgcagtggctcacacctgtaatcccagcactgtgggaggccgaggtgggtggatcacctgaggtcgggagttcgagaccagcctgaccaatatggagaaaccctgtctctaccaaaaatttaaaattagcccggcgtggtggcgcatgcctgtaatcccagctacgcgggaggctgaggcaggagaatttcttgaacccaggaggcagaggttgcggtgagctgagattgcatcattgtactccagcctgggcaacaagagtgaaactctgtctcaaaaaaaaa

SEQ ID NO: 65800 - DNA, 333 bp, Homo sapiens
atgaccttatgccaactcctgccccaaacttcccagggagtgtggatccctgagggtgaatcaatcaagattccagtctgcattaaagtcattgaggacaagagtggacggcagagttttcaagctgtgacagatgtaagtgaaggaaattctgtatgccgctaggagagaggacaatattagatacaatcatgtagaagcagggtcctgtgcttctcagcagctactatgttagccagaatgttgggggtgggggggcctgggctggctgtgcacatgctgagtgtatgtgaacctgttggtttcctagataataccttttgtgtctcttag

SEQ ID NO: 65801 - DNA, 463 bp, Homo sapiens
tagtctctcctctcatcctgtctccttattctcagccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcggtgagggaaagggtctgctaggtggtgagaatagggagtcagggaggagagggctgaaaggactattctgccctagacgtgggagtagggttgagggatggaaccaaggagaagggggctgttaggctggaagcagtaacgaggaagaataatgaagagagggcttgctgggagtcctcagactcctctcctaacccaccccttcctttccagtggcagagg

SEQ ID NO: 65802 - DNA, 2644 bp, Homo sapiens
cccgattcggactctgatcaccggctcaatggatgccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatgggtacagtaaggggagccagtcaaggatgggtgggggtggggccctgcaatggaactgttcaggtggcatacaataaaagtctttagacagctttctgcatgtgccttggtgggattgaggtaggagacctgtggttgtgagatcggagcatgaaggtcaggacttggaagtgacccccccctccctttattccccactacagggagcctcgagaatttgcccatgaggccgaatgcttctcctgccacccggaatgccaacccatggagggcactgccacatgcaatggctcggtatactagtagcaccaggatctccaagggagacagagaaggggcaatacttggagcatctggggaatgatatggctaaggatagcacagagaggccagataatgctagggcctgcagatagaagatcctgaatgtctgggttggtctttgctgggaggtatggaattgaccttgggatctgattcttcctgaccttctctcttccactcagggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaaggggcatgtaacag

SEQ ID NO: 65803 - DNA, 843 bp, Homo sapiens
cccgattcggactctgatcaccggctcaatggatgccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcggtgagggaaagggtctgctaggtggtgagaatagggagtcagggaggagagggctgaaaggactattctgccctagacgtgggagtagggttgagggatggaaccaaggagaagggggctgttaggctggaagcagtaacgaggaagaataatgaagagagggcttgctgggagtcctcagactcctctcctaacccaccccttcctttccagtggcagagggcaaagtgtgtgacccactgtgctcctctgggggatgctggggcccaggccctggtcagtgcttgtcctgtcgaaattatagccgaggaggtgtctgtgtgacccactgcaactttctgaatgggtacagtaaggggagccagtcaaggatgggtgggggtggggccctgcaatggaactgttcaggtggcatacaataaaagtctttagacagctttc

SEQ ID NO: 65804 - DNA, 630 bp, Homo sapiens
cccgattcggactctgatcaccggctcaatggatgccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatgggtacagtaaggggagccagtcaaggatgggtgggggtggggccctgcaatggaactgttcaggtggcatacaataaaagtctttagacagctttc

SEQ ID NO: 65805 - DNA, 828 bp, Homo sapiens
cccgattcggactctgatcaccggctcaatggatgccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcggtatactagtagcaccaggatctccaagggagacagagaaggggcaatacttggagcatctggggaatgatatggctaaggatagcacagagaggccagataatgctagggcctgcagatagaagatcctgaatgtctgggttggtctttgctgggaggtatggaattgaccttgggcgtacggggaggggatactctaaag

SEQ ID NO: 65806 - DNA, 637 bp, Homo sapiens
tgacagccgccaacacagagccctggagaggtggggagctgctgaagggcgggagaagttgcggcgtggcgataggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaaaaaaaa

SEQ ID NO: 65807 - DNA, 706 bp, Homo sapiens
atcacaatgggcagtgcccatcctggagggggcatcagtgtggggtgggagcaggaaggctgttggggaaggaagctgagagatcctctgcaggaggggattatagcagctaagggcacctgccaggctggaggtgtggcctgtctaggggaagggtggtcactgatgtccagcaggagcccttgacaggtagagcccaccacggcatctccaagaccacaccatgttcctgttctcccgtaagaccaggacccctatcagtacctacagtgactcctacagggctcccacctccatcaaggaggtctataaggacccacccctgtgtgcctgggaagccaacaagtttctgactccgggtctgactcataccatggagcgacatgtggatcccgaagccctgcagaagatggccaaatgtgctgtacaggactacacttatagggggtccatatcaggccacccctacttgcctgagaagtactggctttctcaagaggaagcagacaaatgcagcccaaactacctgggcagtgactggtacaacacatggaggatggaaccttacaacagcagctgctgcaacaagtataccacctaccttcctcggctgcctaaggtatctgttgcacccagcacagacgtctggggactgggacacgcataccccaccacctcccaaactacagtgactgatatttcacca

SEQ ID NO: 65808 - DNA, 501 bp, Homo sapiens
tgacagccgccaacacagagccctggagaggtggggagctgctgaagggcgggagaagttgcggcgtggcgataggtctgggtgttctgggaggacccctaaaagggagcagctctgccaggtcagagcttgaggtagcatgtgtgccgcttccaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactaaggttcgcagggctccgcccgcctcagccgggctccac

SEQ ID NO: 65809 - DNA, 299 bp, Homo sapiens
aaaggcccaacccctccatgctcgcggcttcctccttctccagatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaaaaaaaa

SEQ ID NO: 65810 - DNA, 718 bp, Homo sapiens
tgacagccgccaacacagagccctggagaggtggggagctgctgaagggcgggagaagttgcggcgtggcgataggtctgggtgttctgggaggacccctaaaagggagcagctctgccaggtcagagcttgaggtagcatgtgtgccgcttccaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaaaaaaaa

SEQ ID NO: 65811 - DNA, 1181 bp, Homo sapiens
atcacaatgggcagtgcccatcctggagggggcatcagtgtggggtgggagcaggaaggctgttggggaaggaagctgagagatcctctgcaggaggggattatagcagctaagggcacctgccaggctggaggtgtggcctgtctaggggaagggtggtcactgatgtccagcaggagcccttgacaggtagagcccaccacggcatctccaagaccacaccatgttcctgttctcccgtaagaccaggacccctatcagtacctacagtgactcctacagggctcccacctccatcaaggaggtctataaggacccacccctgtgtgcctgggaagccaacaagtttctgactccgggtctgactcataccatggagcgacatgtggatcccgaagccctgcagaagatggccaaatgtgctgtacaggactacacttatagggggtccatatcaggccacccctacttgcctgagaagtactggctttctcaagaggaagcagacaaatgcagcccaaactacctgggcagtgactggtacaacacatggaggatggaaccttacaacagcagctgctgcaacaagtataccacctaccttcctcggctgcctaaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcgggtgcgtggacccgctgcccggccgcctgcccttccatggttacgaaagtgcttgctcgggccgccactactgtctgcgcgggatggactactacgccagcggggcgccctgcaccgaccgccgcctgcggccttggtgccgggagcaaccgactatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaaaaaaaa

SEQ ID NO: 65812 - DNA, 564 bp, Homo sapiens
tgacagccgccaacacagagccctggagaggtggggagctgctgaagggcgggagaagttgcggcgtggcgataggtctgggtgttctgggaggacccctaaaagggagcagctctgccaggtcagagcttgaggtagcatgtgtgccgcttccaggaggccaggatggagacagcagttcgaggaatgcccttggaatgccctcctaggccggagcggctcaatgcctacgagcgcgaagtgatggtgaacatgctgaactcactgtcgcggaaccagcagctgccgcggatcacgccccgatgcggatgtgtacctccctacgagcaccggcccggaatgcagtgtgctgttacaactcccccgccgtcatactacccatatccgaaccttagatgggacacaagtcacttcaagaagtctggtggtccccagagaaacaactatgttatccatcctgagtttgtgtctgagacctatcccgactatcgttgctggtagagcctgggcttgctgtgccaagggggcagagcaataaataaactcttcaaccccaaaaaaaaa

SEQ ID NO: 65813 - DNA, 941 bp, Homo sapiens
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagtgagtatctgctacctgagatactgccctgcctcaactctgtccctcttagctccaggctagactgttggtacagttggactttcccttggattaggtagaaataaaggttgggatgggttgttttagggactctgggaggagtgttgatgttgtggatattttttctggaaaatgggattttattgttccatgggcttcaagagagcgtagaatcaggaggcgaatggctctgagggccctgctcttcttgctaaggagcccttccccagctcctggctcctgtaccagctgccacccttacagccctttagccacatgaggcctctggagaggagggcagtgctgggctggatttccaagagatgaataatggagaagcctgattgtgcagtggggaaactggagctgggggcttggtggccagctgacatgggctgtaaccagagacaggctgggagccatatccctacccccaattctttat

SEQ ID NO: 65814 - DNA, 3731 bp, Homo sapiens
  misc_feature (3731)..(3731): n is a, c, g, or t
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagagacagagagagaagatcctgggcaggaaggagagggtagtcagagctatctgcccaaagagtactaagagaggattaggcccatctgatcatgttaccccaaggggtaaactctagaccccacagcttcaggcccaaggtttatgtggcctgcagaagtagaagaagtagaggtatttcttttttttttttttttgagacggagtcttgctctgtcacctaggctggagtgcagtggcacaatctcggctcactgcaacctccgcctcccggcttcaagcaattctcctgcttcagcctcccaagtagctggaattataggcgcccaccaccacgccgggctaatttttttgtctttttagtagagatggggtttcatcgtgttagccaggatggtctcgatctcctgacctcgtgatccacccgcctcggcctcccaaagtgctgggattacaggcatgagccactgtgcccggcccagaagtagaggtatttctaaggctactggtctatgcagattctccaaacttaagtatggtttgggcagaagctgggagatagaagtttgagaacatgctggctgcagcagcagatccgggtttaaatcttggccaagttaaccaaagctttgagttgtcttcccctctccaggcctatgtgtctgtgaagtgagggtatacacactggcatgctgtaagaacaggagatagcagagtgctgagtacacagaggtacttaaaggtgggagccattactttcgccatgagtcaagttatctttggctgcgatcattgatgtctctctttcctgctcttttacctcagctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65815 - DNA, 3783 bp, Homo sapiens
  misc_feature (3783)..(3783): n is a, c, g, or t
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgtccagagtccttctggccacatctctgagcctgcctccttcttgcttctcagcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagagacagagagagaagatcctgggcaggaaggagagggtagtcagagctatctgcccaaagagtactaagagaggattaggcccatctgatcatgttaccccaaggggtaaactctagaccccacagcttcaggcccaaggtttatgtggcctgcagaagtagaagaagtagaggtatttcttttttttttttttttgagacggagtcttgctctgtcacctaggctggagtgcagtggcacaatctcggctcactgcaacctccgcctcccggcttcaagcaattctcctgcttcagcctcccaagtagctggaattataggcgcccaccaccacgccgggctaatttttttgtctttttagtagagatggggtttcatcgtgttagccaggatggtctcgatctcctgacctcgtgatccacccgcctcggcctcccaaagtgctgggattacaggcatgagccactgtgcccggcccagaagtagaggtatttctaaggctactggtctatgcagattctccaaacttaagtatggtttgggcagaagctgggagatagaagtttgagaacatgctggctgcagcagcagatccgggtttaaatcttggccaagttaaccaaagctttgagttgtcttcccctctccaggcctatgtgtctgtgaagtgagggtatacacactggcatgctgtaagaacaggagatagcagagtgctgagtacacagaggtacttaaaggtgggagccattactttcgccatgagtcaagttatctttggctgcgatcattgatgtctctctttcctgctcttttacctcagctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65816 - DNA, 3761 bp, Homo sapiens
  misc_feature (3761)..(3761): n is a, c, g, or t
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactggcctctcttagccacagctggatttttgcaatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagagacagagagagaagatcctgggcaggaaggagagggtagtcagagctatctgcccaaagagtactaagagaggattaggcccatctgatcatgttaccccaaggggtaaactctagaccccacagcttcaggcccaaggtttatgtggcctgcagaagtagaagaagtagaggtatttcttttttttttttttttgagacggagtcttgctctgtcacctaggctggagtgcagtggcacaatctcggctcactgcaacctccgcctcccggcttcaagcaattctcctgcttcagcctcccaagtagctggaattataggcgcccaccaccacgccgggctaatttttttgtctttttagtagagatggggtttcatcgtgttagccaggatggtctcgatctcctgacctcgtgatccacccgcctcggcctcccaaagtgctgggattacaggcatgagccactgtgcccggcccagaagtagaggtatttctaaggctactggtctatgcagattctccaaacttaagtatggtttgggcagaagctgggagatagaagtttgagaacatgctggctgcagcagcagatccgggtttaaatcttggccaagttaaccaaagctttgagttgtcttcccctctccaggcctatgtgtctgtgaagtgagggtatacacactggcatgctgtaagaacaggagatagcagagtgctgagtacacagaggtacttaaaggtgggagccattactttcgccatgagtcaagttatctttggctgcgatcattgatgtctctctttcctgctcttttacctcagctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65817 - DNA, 2708 bp, Homo sapiens
  misc_feature (2708)..(2708): n is a, c, g, or t
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactggcctctcttagccacagctggatttttgcaatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65818 - DNA, 3243 bp, Homo sapiens
  misc_feature (3243)..(3243): n is a, c, g, or t
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagagacagagagagaagatcctgggcaggaaggagagggtagtcagagctatctgcccaaagagtactaagagaggattaggcccatctgatcatgttaccccaaggggtaaactctagaccccacagcttcaggcccaaggtttatgtggcctgcagaagtagaagaagtagaggtatttcttttttttttttttttgagacggagtcttgctctgtcacctaggctggagtgcagtggcacaatctcggctcactgcaacctccgcctcccggcttcaagcaattctcctgcttcagcctcccaagtagctggaattataggcgcccaccaccacgccgggctaatttttttgtctttttagtagagatggggtttcatcgtgttagccaggatggtctcgatctcctgacctcgtgatccacccgcctcggcctcccaaagtgctgggattacaggcatgagccactgtgcccggcccagaagtagaggtatttctaaggctactggtctatgcagattctccaaacttaagtatggtttgggcagaagctgggagatagaagtttgagaacatgctggctgcagcagcagatccgggtttaaatcttggccaagttaaccaaagctttgagttgtcttcccctctccaggcctatgtgtctgtgaagtgagggtatacacactggcatgctgtaagaacaggagatagcagagtgctgagtacacagaggtacttaaaggtgggagccattactttcgccatgagtcaagttatctttggctgcgatcattgatgtctctctttcctgctcttttacctcagctgccctgtgagctacaggacatggttcggaaacatttgcacagtggtcaagaggccgccagcccaggtcctgctcccagcctagccccaggggctgtggtgcctacctcagtcattgccactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65819 - DNA, 2917 bp, Homo sapiens
  misc_feature (2917)..(2917): n is a, c, g, or t
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagagacagagagagaagatcctgggcaggaaggagagggtagtcagagctatctgcccaaagagtactaagagaggattaggcccatctgatcatgttaccccaaggggtaaactctagaccccacagcttcaggcccaaggtttatgtggcctgcagaagtagaagaagtagaggtatttcttttttttttttttttgagacggagtcttgctctgtcacctaggctggagtgcagtggcacaatctcggctcactgcaacctccgcctcccggcttcaagcaattctcctgcttcagcctcccaagtagctggaattataggcgcccaccaccacgccgggctaatttttttgtctttttagtagagatggggtttcatcgtgttagccaggatggtctcgatctcctgacctcgtgatccacccgcctcggcctcccaaagtgctgggattacaggcatgagccactgtgcccggcccagaagtagaggtatttctaaggctactggtctatgcagattctccaaacttaagtatggtttgggcagaagctgggagatagaagtttgagaacatgctggctgcagcagcagatccgggtttaaatcttggccaagttaaccaaagctttgagttgtcttcccctctccaggcctatgtgtctgtgaagtgagggtatacacactggcatgctgtaagaacaggagatagcagagtgctgagtacacagaggtacttaaaggtgggagccattactttcgccatgagtcaagttatctttggctgcgatcattgatgtctctctttcctgctcttttacctcagctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaactattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65820 - DNA, 338 bp, Homo sapiens
tgggctgggttaacctcaagtctgtgcttcagatcaagaaggctgagatggataggaagacgctggactgggagattgtggagctgaccaacaagctgctggatgccaagaacaccatcaacaagctggaagagctcaatgtatgtgcgcttcactactcgggccttcctcacctggggctagctttgtcctggctcggccctgcttccttggagagggctgggctgggctctgaaacaggtctgtgtctgtaggagcggtaccggctggactgcaacctggctgtacagctcctcaagtgcaacaagtcccacttccgaaaccacaagtttgccgat

SEQ ID NO: 65821 - DNA, 2730 bp, Homo sapiens
  misc_feature (2730)..(2730): n is a, c, g, or t
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgtccagagtccttctggccacatctctgagcctgcctccttcttgcttctcagcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65822 - DNA, 4050 bp, Homo sapiens
  misc_feature (4050)..(4050): n is a, c, g, or t
aatggagtaaggtccgaggcggagaggaaaaaaaggagctggggcggaccggggccctagggtccagtggcagccctaggggagggggatttgggggcggggcagccagaagtaggtgttgtgcaggccctggagaagcagagtcacaagttggaggaaaatttcttagccgcgaataaagaagcctggagcgtgggatagaggcccgactgtatctggccggccagaggggaaagggatctttctagtagagtgggatagtgaggaagagagatctggaggatgccgggcagatctgctaaggagggaactaaagccagtcaaatgaccctcttctaggcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggtcagcaagactggtatcacagcctgaccggcagaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagagacagagagagaagatcctgggcaggaaggagagggtagtcagagctatctgcccaaagagtactaagagaggattaggcccatctgatcatgttaccccaaggggtaaactctagaccccacagcttcaggcccaaggtttatgtggcctgcagaagtagaagaagtagaggtatttcttttttttttttttttgagacggagtcttgctctgtcacctaggctggagtgcagtggcacaatctcggctcactgcaacctccgcctcccggcttcaagcaattctcctgcttcagcctcccaagtagctggaattataggcgcccaccaccacgccgggctaatttttttgtctttttagtagagatggggtttcatcgtgttagccaggatggtctcgatctcctgacctcgtgatccacccgcctcggcctcccaaagtgctgggattacaggcatgagccactgtgcccggcccagaagtagaggtatttctaaggctactggtctatgcagattctccaaacttaagtatggtttgggcagaagctgggagatagaagtttgagaacatgctggctgcagcagcagatccgggtttaaatcttggccaagttaaccaaagctttgagttgtcttcccctctccaggcctatgtgtctgtgaagtgagggtatacacactggcatgctgtaagaacaggagatagcagagtgctgagtacacagaggtacttaaaggtgggagccattactttcgccatgagtcaagttatctttggctgcgatcattgatgtctctctttcctgctcttttacctcagctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65823 - DNA, 3480 bp, Homo sapiens
  misc_feature (3480)..(3480): n is a, c, g, or t
ccctccaacccaggctgtgttcccagggccagcaggcctatgaaatatgctgccttagactcagactaagactccaggagtttccctgtcctgtttgcctgtcctcatgtcatcccttccttcctgagcccactctggagctccagggcatgcccttctatctctcatacccctctgcccttgatcccacaacaccctgccaggctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagagacagagagagaagatcctgggcaggaaggagagggtagtcagagctatctgcccaaagagtactaagagaggattaggcccatctgatcatgttaccccaaggggtaaactctagaccccacagcttcaggcccaaggtttatgtggcctgcagaagtagaagaagtagaggtatttcttttttttttttttttgagacggagtcttgctctgtcacctaggctggagtgcagtggcacaatctcggctcactgcaacctccgcctcccggcttcaagcaattctcctgcttcagcctcccaagtagctggaattataggcgcccaccaccacgccgggctaatttttttgtctttttagtagagatggggtttcatcgtgttagccaggatggtctcgatctcctgacctcgtgatccacccgcctcggcctcccaaagtgctgggattacaggcatgagccactgtgcccggcccagaagtagaggtatttctaaggctactggtctatgcagattctccaaacttaagtatggtttgggcagaagctgggagatagaagtttgagaacatgctggctgcagcagcagatccgggtttaaatcttggccaagttaaccaaagctttgagttgtcttcccctctccaggcctatgtgtctgtgaagtgagggtatacacactggcatgctgtaagaacaggagatagcagagtgctgagtacacagaggtacttaaaggtgggagccattactttcgccatgagtcaagttatctttggctgcgatcattgatgtctctctttcctgctcttttacctcagctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65824 - DNA, 3096 bp, Homo sapiens
  misc_feature (3096)..(3096): n is a, c, g, or t
aatggagtaaggtccgaggcggagaggaaaaaaaggagctggggcggaccggggccctagggtccagtggcagccctaggggagggggatttgggggcggggcagccagaagtaggtgttgtgcaggccctggagaagcagagtcacaagttggaggaaaatttcttagccgcgaataaagaagcctggagcgtgggatagaggcccgactgtatctggccggccagaggggaaagggatctttctagtagagtgggatagtgaggaagagagatctggaggatgccgggcagatctgctaaggagggaactaaagccagtcaaatgaccctcttctaggcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggagagagccctgcagccctcttctgctataagagtctttgggcttcacacctgagccttcttgtggctatttggagggtgagccagccgggggtccagtggtccagagctgagcctcaagcctctcttttttgcctaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccacacccactgtatcctggccgcagggtaatagagttctctgaggataaggttcggatcccccgcaacagccccctgcccaactgcacttacgctacccgccaggccatttccctgagcctggtagaggaggggagtgagcgggcccgccccagcccagtgcccagcacccctgcctcagcccaggcctcaccccaccaccagcccagcccagcacccctaacactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65825 - DNA, 3510 bp, Homo sapiens
  misc_feature (3510)..(3510): n is a, c, g, or t
acccggcctgccccgcggcaagatggcggcctgaacgcagctggcagcggcggaaagcttagatcagcctttccacagctgttagcagcatctgccccaatttcagctgaagattcaggtgccccagggactggaagaaattacagtgcctacttggaaagaagaagagatagcgacttgccccagtccaaccccagagcgggagctgtggctaaaggaagtggaggggccgtgggatgcggagagccgagggctaactcccggacagcggaacagagagagctgccgacaaacagacgcaggcggaggagccgtcacctcccagaatgactagtgccgcccctgctaagaaaccctaccgtaaggcaccaccagagcatcgggagctgcgtttggaaattcctggatcccggcttgagcaggaggaacccctgactgatgcagaaaggatgaagctcttacaggaggagaatgaagagcttcgccggcgcctggcctccgccaccagacgcactgaggccctggaacgtgagctggaaattgggcaggactgcctggagctggagctgggccagagccgcgaggagctggacaaatttaaggataagttccgcaggctgcagaacagctacacggcttcccagcggaccaaccaggagttggaggacaagctgcacacactgatcaagaaggctgagatggataggaagacgctggactgggagattgtggagctgaccaacaagctgctggatgccaagaacaccatcaacaagctggaagagctcaatgagcggtaccggctggactgcaacctggctgtacagctcctcaagtgcaacaagtcccacttccgaaaccacaagtttgccgatgtgagtagaactcaccccctccctgcccacatagaccattccggccactgtaggactcctctaactccagtttctgcacctctctctgtcctcctcttcccactttgccctcctcttgcctccatgtcacctctcaagccagtcaactctgccactggttggtgtcccgtgtactgtccagggcccatcactagttctggggggccagccctgttggtttctgtaacagagacagagagagaagatcctgggcaggaaggagagggtagtcagagctatctgcccaaagagtactaagagaggattaggcccatctgatcatgttaccccaaggggtaaactctagaccccacagcttcaggcccaaggtttatgtggcctgcagaagtagaagaagtagaggtatttcttttttttttttttttgagacggagtcttgctctgtcacctaggctggagtgcagtggcacaatctcggctcactgcaacctccgcctcccggcttcaagcaattctcctgcttcagcctcccaagtagctggaattataggcgcccaccaccacgccgggctaatttttttgtctttttagtagagatggggtttcatcgtgttagccaggatggtctcgatctcctgacctcgtgatccacccgcctcggcctcccaaagtgctgggattacaggcatgagccactgtgcccggcccagaagtagaggtatttctaaggctactggtctatgcagattctccaaacttaagtatggtttgggcagaagctgggagatagaagtttgagaacatgctggctgcagcagcagatccgggtttaaatcttggccaagttaaccaaagctttgagttgtcttcccctctccaggcctatgtgtctgtgaagtgagggtatacacactggcatgctgtaagaacaggagatagcagagtgctgagtacacagaggtacttaaaggtgggagccattactttcgccatgagtcaagttatctttggctgcgatcattgatgtctctctttcctgctcttttacctcagctgccctgtgagctacaggacatggttcggaaacatttgcacagtggtcaagaggccgccagcccaggtcctgctcccagcctagccccaggggctgtggtgcctacctcagtcattgcccgagtgttagagaagccggagtctctactgctcaattcagcccagtcaggcagcgccgggcgccccttggctgaggatgtctttgtgcatgtggacatgagtgagggtgtcccaggtgatccagccagtcccccggcccctggcagccccaccccacaacccaatggggagtgccactctctgggtactgccaggggctccccggaggaagagctgcccctgccagcctttgagaagctgaacccctacccaaccccgtctccaccaactcagtgccccagctagctctgccagctctgaagaggacctgctggtcagctggcagcgggcatttgtggaccgtactccaccacctgctgctgtggcccagcgcacagcctttggacgcgatgccctccctgagctgcagcgccattttgcccatagccccgctgacagagatgaggtggtccaggcaccttctgcccgacccgaagagagtgagcttttgctacccacagaacctgactctggctttcccagggaggaagaagagctgaacctgcctatcagtcctgaggaagagcgccagagcctgctgcccattaacaggggcacagaggaggggccaggcacttcccacaccgagggcagggcctggccactccccagctccagtcgcccccagcgcagccccaagaggatgggggttcaccacctgcaccgcaaggacagcctgacccaggcccaggagcagggcaacctgctcaactagggcccctgctggccttcctgccattgctgcaccaggactgcaaggagtccccacaccttggcagctcagggtccccagtccaagcccttgacctctcctctatccagacccgcacagctgtttcctgtgtggatggggtcaggttgtgggccatgccaggcctgtcagctgcgttgactgactgcagcagcttgcctcatggttttccctttttcttagaatatttattcttcagaggtaacatgcagttgggtctcaagacctttcctccaatcagcccaacccagcccagactgggcttttctggggagctgaggagtttatcagtattcatcttccatcctttcatagtcacaagttttgttattttgtttttttttgggggtgatggtgtaattgttaacctcatttccgtttcctacctgtttgcttccccccccagtcctccgcatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65826 - DNA, 317 bp, Homo sapiens
  misc_feature (317)..(317): n is a, c, g, or t
gcggccgcctactactactactactgctcgaattcaagcttctaacgatgtacggggacatgagctgttgccctccaggggcctggcacagctggccttggggacgagggagaggactgattcagggccccctcagctgtctcctccctccctctggaaaggagggtggggctcaggggcctcaagctgggctctgtgtgaggcctggcccccactcccaaccttggctctagactgttactcttaagctttgagaaattttcacattgatgactattttaaaatcaaataaaactattttactggtaaaaaaaaan

SEQ ID NO: 65827 - DNA, 1920 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgta

SEQ ID NO: 65828 - DNA, 655 bp, Homo sapiens
gatggataatcattttaatataacaaaatcacaagtagagcctcacagagggggtagctgtcctttcttttctatgtaattgatgctatttatttagaaggtctatggtttacccttgtgaagtaatttttctgtatgtgtattttttttccagcttagatggaaaccatttgagattccaaaagcatctcagaagaaagtagactttgtgagtgtaagtcagtcccatccacaccctccctactgctctcctctcttctgtggtgagtgagccaaccatttgcagcctgaatgccaagcagaagcagccctatcaggaggcagcagagacaaaaccacctgcgtatgctttgggggctggcggagggatgtcttacttacagaaaccatatggcccctgacaccagagggtattcatgaactatttatatctcagaaaggccaatgacaattgaacattttcttacttaagttcctttcttttggctagaacgggggcttttaacctttttctcactttgatgtctgatgtctgatgatgtctttgtttataaatatataaaataaattatataaaattacaaagaagctaatgatattgaaatataacgataaaaatactattaaaaacaaatttgatttggtttatagtcaa

SEQ ID NO: 65829 - DNA, 544 bp, Homo sapiens
aaatggtaggaccagagccacaactcagggcttgagcctgctctcctcaccactctagcacacaaatctttgatttgttattggaagatttcacctacccataccttctgttgacatctaatcaaatgtgtttattatctatctcacctcttttttctcatccccatcgtcacttcctccaggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgta

SEQ ID NO: 65830 - DNA, 785 bp, Homo sapiens
aaagcctttctcttcatgcaaccatgggcatctttcctatgttttggaagtttctaaaagacttttgggttactgttttctaggggccaatggcttggccaatcctcgtgatttcttgatacccattgcctggtatgaggatcgccaagtaccaggtggttacacggtcattaataaataccagggcaagctgtttgctgccaaacaggtaaagtaaaagggttggcaggcaagggaggaaatgaagagtgattgagcacttactgattgccaaggcgagtgttacaaactttacatatatcctttcgttgttatcataccactacggcactacaaataaagcaaatagttctagtagtcaattatactttcatagtcatggaaaaggccagtaatgataaataatttaccaatttcacagtaagtggcagaaccagaatttgaacccatatctgtctgactccaaaggttgtgccctttctactcaccaagcaatgaaaatattagcaatatgtaggtttctataagtggtatggaaaacataatatatgggcagcataatatgttcctatttcaaatacaagcaattctacaaaacaagtagaattcagttaattagcttggcttggtttgtaccaccaggctggcaattcaggacacaagcaaaggcacagatattaataaataataataacaacaatgtaatatggactctataacataatatattactaaatgtactgaatatatattagaataaaataatcatataataagaagaaccc

SEQ ID NO: 65831 - DNA, 2179 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataatctagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaaccttccggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgta

SEQ ID NO: 65832 - DNA, 2122 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataatctagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaaccttccaaaaaaaaaaaaaaaaaaaaaaaaaaaaaaaaaaaaaaaaaaaaaaaaaaaaaaaaaaaaaaaaaaaagagagaggaggaaaaaaaaaaaaaaaaaaaagagaaaagaaaaaaaagaaaaaaaaaaaagaaaaaaaaaaaaaagggaggaaaaagaagtgtcacggcggaggaacaaccaaaacacaacccaccaaacggaacagcagaaaaaaaggagagccactacacgctactcatagggagaaaaaaacaaaagctaacaacaacgagggcgcgcagcacaagattgatcaagccacacacgaggacggcacacaacaaaaaaaacgacggcgagagcactccagacaaaacaccgaacacgatcacatacaagaggcgcacacacgacagacaatagaacaccgagaacaagaaatgcccaacgaaacagcaaaagaaacgagacaaataattacacgaagcacggaacaaagactcaaaga

SEQ ID NO: 65833 - DNA, 1866 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgta

SEQ ID NO: 65834 - DNA, 1861 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccaggtaacctggtcctgtgaattgaactggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgta

SEQ ID NO: 65835 - DNA, 1949 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattgattccttgggtcttcctaaaaggatgtctccccgttcaatgttgtggcctggcacgggaattatacaccctacaagtacaacctgaagaatttcatggttatcaactcagtggcctttgaccatgcaatctagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaaccttccggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgta

SEQ ID NO: 65836 - DNA, 1565 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgta

SEQ ID NO: 65837 - DNA, 1051 bp, Homo sapiens
ggacttgtatcagagttttctctgcaatactccagtggagaacaggagtgctttatacaattcagatggggacttctatgattgtcctgagggagttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgta

SEQ ID NO: 65838 - DNA, 466 bp, Homo sapiens
aaaaccacacaccctcaatctaagccttctagattgggaattagaaatatgctgttgctgtgtcctacagtggagctacttgggaaagggttatgatctgggagataagataactttgatacagggctcgtaagcttagatgatagagtacattcgctctctattatgactagcattttaattattattatcttctctgggccctgatatctagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaaccttc

SEQ ID NO: 65839 - DNA, 788 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccaggtaacctggtcctgtgaattgaagcttatcatatacccaaagccttgactagaaatacctaaatagaataccatggtcattggaaaaaatagatagttttttaaagtattattttaataaatgctaaagtgtgtct

SEQ ID NO: 65840 - DNA, 2358 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgtaaaaaaacacaaaaaaacacacacagggcgaaaacaaaacaaccgaaccataacaccaccacacaaatttttcgtgcggcggcggctccggcctcgtgaaaaagtttttaaacaaccacatatttttgggagccgcgggcccacaaatgggtaagtgacaacacactggccacagaggagtcgaccccacagagaaaactgctggacaccatagcaatcgacggatgtgtaactcccaccgcaataaaaataatccgcggcgtgcgtcaccagagagcttgttggagaaacacacacacaggaagggcgcatgcgcaggcctaaacagaggagctcataaacagaggggtcacagaggaaggcggagttgtaactaataaagcgcccgcagtagggcttacaacgataacgcacacaactgacaacgagccagccacgc

SEQ ID NO: 65841 - DNA, 1877 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataatctagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaaccttccggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatgcgcacttgatgttgaatatcttaatacccccacaaagtgagacacaagccctgttaagtg

SEQ ID NO: 65842 - DNA, 2054 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataatctagcctgattcctgtcagagagtggaactcgagacctctgataatccacatggccatggagtagagctgtgcctgccaagaatgccaatatgaatgttttatgattgttcttctgtcaatccatattctttattaatcctatacaatttactagtttctcctgtgttcttggaattctgcagaaataatgtttaaggggctttgtgttttactggtcttgccttggataataaaaataatactgcttcaaccttccggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgta

SEQ ID NO: 65843 - DNA, 1775 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattggggccaatggcttggccaatcctcgtgatttcttgatacccattgcctggtatgaggatcgccaagtaccaggtggttacacggtcattaataaataccagggcaagctgtttgctgccaaacaggtaaagtaaaagggttggcaggcaagggaggaaatgaagagtgattgagcacttactgattgccaaggcgagtgttacaaactttacatatatcctttcgttgttatcataccactacggcactacaaataaagcaaatagttctagtagtcaattatactttcatagtcatggaaaaggccagtaatgataaataatttaccaatttcacagtaagtggcagaaccagaatttgaacccatatctgtctgactccaaaggttgtgccctttctactcaccaagcaatgaaaatattagcaatatgtaggtttctataagtggtatggaaaacataatatatgggcagcataatatgttctgaaaagtaaatgagttaacagatcagccaagatttatagtctccaataccaccctatttcaaatacaagcaattctacaaaacaagtagaattcagttaattagcttggcttggtttgtaccaccaggctggcaattcaggacacaagcaaaggcacagatattaataaataataataacaacaatgtaatatggactctataacataatatattactaaatgtactgaatatatattagaataaaataatcatataataagaagaaccc

SEQ ID NO: 65844 - DNA, 892 bp, Homo sapiens
aatcgagaacaaaatcaaatcaaaagaagagagaggtatactcagtacatattgtgggatcacagctacaaaagcattagatggtaaaattatcctttcctgctttttgtgtttaggatgtctccccgttcaatgttgtggcctggcacgggaattatacaccctacaagtacaacctgaagaatttcatggttatcaactcagtggcctttgaccatgcagacccatccattttcacagtattgactgctaagtctgtccgccctggagtggccattgctgattttgtcatcttcccacctcgatggggggttgctgataagaccttcaggcctccttattaccataggaactgcatgagtgagttcatgggactcatccgaggtcactatgaggcaaagcaaggtgggttcctgccagggggagggagtctacacagcacaatgaccccccatggacctgatgctgactgctttgagaaggccagcaaggtcaagctggcacctgagaggattgccgatggcaccatggcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgta

SEQ ID NO: 65845 - DNA, 1824 bp, Homo sapiens
ccacagttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccatgtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcaggatgtctccccgttcaatgttgtggcctggcacgggaattatacaccctacaagtacaacctgaagaatttcatggttatcaactcagtggcctttgaccatgcagcatttatgtttgaatcatctttaagtctggcggtcacaaagtggggactcaaggcctccaggtgtttggatgagaactaccacaagtgctgggagccactcaagagccacttcactcccaactccaggaacccagcagaacctaattgagactggaacattgctaccataattaagagtagatttgtgaagatttcttcagaatctcatgctttctggtagtattggaggagggggttggttaaaatgaaaattcacttttcatagtcaagtaactcagaacttttatggaaacgcatttgcaaagttctatggctgtcaccttaattactcaataaacttgctggtgttctgtggacgtaaaaaaacacaaaaaaacacacacagggcgaaaacaaaacaaccgaaccataacaccaccacacaaatttttcgtgcggcggcggctccggcctcgtgaaaaagtttttaaacaaccacatatttttgggagccgcgggcccacaaatgggtaagtgacaacacactggccacagaggagtcgaccccacagagaaaactgctggacaccatagcaatcgacggatgtgtaactcccaccgcaataaaaataatccgcggcgtgcgtcaccagagagcttgttggagaaacacacacacaggaagggcgcatgcgcaggcctaaacagaggagctcataaacagaggggtcacagaggaaggcggagttgtaactaataaagcgcccgcagtagggcttacaacgataacgcacacaactgacaacgagccagccacgc

SEQ ID NO: 65846 - DNA, 452 bp, Homo sapiens
ccacactctattcaaaatggagtcactcttgttcaaatgcctctgacaaaagcggtgtgacaagcctgggattcccatagtgatcatgctggtaggagtgaggtgttattatttagaaacactattgcacccgctaaggatatgcatggataaggcagctggagaacaaatacaaaaatcttaattaaaagaccgttttgtgaggtcttcaacttcttctccatttcaccaacacgctgcacagtctgtgtattcagcgtcaccaaagagatttttaattcatcagcctggtttttgtggattgttcgttgccttctcagtgctgtaacacatagagacactggtacaggcattaggaaggatgggagaagataccaaatggtataagacatggtctggtatttccagggataggatcatccatttaggaaaacagctacatagagacatgc

SEQ ID NO: 65847 - DNA, 759 bp, Homo sapiens
gttcaagaccagtctgaccaacatggagaaaccccatctctactaaaaatacaaaaaattagctaggcctagtggcgcatgcctgtaatcccagctacttgggaggctgaggtaggagaatcgcttgaacctgggaggcgggggttgtggtaagccgagactgtgtcattgcactccagcctgggcgacaagagcgaaactctgtctcaaaaaaaaaaaaaaacacattacagtgtttgccaacatcctaaaacaaaaaataatgatttttgggaaaaacaaaaaattatttaactattttgattgactatagggatcttagcttggctaaatcaacaatatagcaatgtatcttaatgctctaaaaagtaacaatacctaggactgactgaatgttaatttctggaattcatttatcttgttttatttgccttgttcagtatttttcatttaccatatgaagtttagaaataacaatttccttaagttaacttcaataagacagttttgatggtgggaccttggcagaagtatattgagtcagtgccggctgcgttcatggcttcttgtcagggtagtaacattttgcaaccaaatctgcacagatttgtagccaagtctacaaagtgcttaacagctcttttcattgcatcctgtgagatggttgtgatgatccaggaaatggggtctcaggaatctgaagaagctgcctgagccaaggtgatttctaggagtttttttgtttgtggtatgtgaatt

SEQ ID NO: 65848 - DNA, 293 bp, Homo sapiens
aattgaatcctgtcaacaacgatactcatcactcacttcagatgttactttaagacattctggagcagcgtcatgtgcaggaacaataaggaagtgagtgcttttgtaattcctgaacaactgtgtcttacacttactaagggattcatgggcaatatgactgaataggaacagctccagtctgaagctcccagtgagaccaacatagaaggcaatctgggtgttatgaaagatgtagaccaacagaaacactcatacctttctggtgacaataaaactttgtacatttattt

SEQ ID NO: 65849 - DNA, 600 bp, Homo sapiens
  misc_feature (1)..(4): n is a, c, g, or t
  misc_feature (227)..(227): n is a, c, g, or t
  misc_feature (349)..(349): n is a, c, g, or t
nnnnacttcactaagcagatggagacccccagctgcacacctcttcctctcctctcctctgcacctcaacatgtttccctgtcttctgattcagagaaagaaatgtctgctttcaaggtcagccttgcctcatcctcaggcttcctcagaaaccttgttttctttttcttacagtttcaagctgtctcttgctggcttccccccttgcactacaagtgtgttcacgnctctgctaccttagaaaatgactttctctgatctttattcttcttaactcccgttataccataaggatccattggatccaattttatgttttcagtttctttcttgagtagttctatttgtnaggattgatacttcataaattttattctttcttggaggtcttccaaagaacaaagagaaaatgcacttttaaaaaatacacagaataaaactcattctgtcttggaattaccacatggatccagtgaatcaacctaagttacattacaagatcttaataactaacttgtttttctatatcctgaaacatttagcgatttcatcattctaaaaattatttcatcactactcatcaattattcctaaatacgc

SEQ ID NO: 65850 - DNA, 396 bp, Homo sapiens
gaaaacagactatagggattatcaggagaacaagaaaaaaatgccaagtgttgaatttggaaaagtcgtaacaagttagtctgtagccataaacagaaagtaaaacagaaaatgctccctctacaaaagattccctgtgtgattgaaatgaaatccaaggaaatgtacgaagacataactttgatttagccttcaccagggaaggtagaaaatctcaggaaccaaaattaaataacttgtgatatctctttcctaggacactctttactgaaaagcagtagtgtcagaaatatacccctagtatgaatatatgtatatgtacatatataaacttgtgtttatgtatgtgggtgtggacatacatatgtaggcatggctgtgtgtgtatatactcaa

SEQ ID NO: 65851 - DNA, 423 bp, Homo sapiens
ggatggttgaggggaagaccagggggctggtatgtagttggtccccaacagcagtgtattggtgtactcgaccctccagtgtgattctgggcatgagacaagactcttgttctcatgaagcagggcatcagggaatgggagttggtgaggaaattacattaacatttattgagcaccattctcactataaacctgaacgtaaatattattattattattattattattattattattattattattattattattttagtagagatgaggccttgctgtgttgcctagactggtcttgaactcctgggctcaagcaatcctctcaccttggcctctcaaagtgcctctcaaaggtgtgagccaccatgcccagcctattcgtttttaatttctgaagaaactgaggctaacagctgggtctgg

SEQ ID NO: 65852 - DNA, 626 bp, Homo sapiens
tcaactgagaaaaacaagacaagggcctatgtgtgtctcaggaaaggttaaaagctcagtgccaatgcaagggatttttacaagcaaaagtctcattattaatgaggccagaaaaccaaaatgacaatgatctttgatgatctgtactgacacgcaggggaggtgacttaatcagaaacacacatttactggcaccccctttgtgcccagtccctgctcctcgaaactgatgtttgtatttcagagtttagctgtctttgagtttgctgcagtgaaaagaaatatcccaagtgtgactgggaagagaagacccgggacaggccagaaactggagtgaggaagaaagaaccacagaatattaatgtaatgaataactttcaagtcctatctggtccgtgtcctggcaaagtcccttggggtctctcccctgctttccgttcatcaggatgactgagctcagtaattgtaacaaagggagtgtagtaggcaaggggacaaaacccatagtatcccacccctgattgacttattaactcaatgaacacttattgaatacctacgatatgccagaagcagttccgggtactggaaatacatcagtgaataaaacagccactcatcctagt

SEQ ID NO: 65853 - DNA, 417 bp, Homo sapiens
ctactactactaaattcgcggccgcgtcgacctgaggtgggaggatcatgtgagcccccaggatgtggaagctgcagtgggctatgatcacgccattgcattccagtccagcctagtgacatagcaaggctctgtctgttagaaaaaaataaggccaggtgtgatggttcaggcctgtaatcccagcactgtgggaagctaaggctgaggtttgagaccagctggcgcaacatggcgaaatcctgtttctactaaaaatacaaaatattagccaggtgtggtggtgcatgcttgtagttccagctactcaggatactaaggtgggaggatcgcttgagcctggaaggtcaaggctacggcgagctttgatggttccactgcactccagcctgggcaacgcagccagactctgtctca

SEQ ID NO: 65854 - DNA, 817 bp, Homo sapiens
  misc_feature (13)..(13): n is a, c, g, or t
  misc_feature (16)..(16): n is a, c, g, or t
  misc_feature (28)..(28): n is a, c, g, or t
  misc_feature (31)..(31): n is a, c, g, or t
ttttcggatgtgnaanaaaagtaatagnaanacctttctgagattcacttctacttaaggcataattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaaatcgtttttccattctgaacctgtgctttcaaatgtgagaataaaagatctgtctgctactggattacagatgagcactttgtagctgatcatctttgcactgccatttgatgaacatgttggtaacggttgcctgccttatgtagcatgaacagttgattctgacaatcaagatcctctgcctgctgcagtggtccatacatgaacagctccccttcagcgccccagctattccaggactcttctccattgtaagaagacaaaaatgtgtctgagatctcatttatgagacaagatcacagcagccactgatataacaaaagtttaggcatttttctcaacacaaagactatcgctggaagtggcacttgctacctggtgcatctttgaaaagtgtgcctttagaaacaagacacccttttaaagtaatatgtcttcaaatgttgtgacttacataaagtagctctttcattacttatatcatttttattaaaaaaacttaagttagactctttttctgtctgttgagtgatttattt

SEQ ID NO: 65855 - DNA, 929 bp, Homo sapiens
gacggacctaccactggccctgcgtatgtggtgcagcctctcttcaatccctaagaactggttctttcaaagcatgtattttctgaagaaactttagaaccacgtttattttaaaagaacgaattggagaaaacaaatcgattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaaatcgtttttccattctgaacctgtgctttcaaatgtgagaataaaagatctgtctgctactggattacagatgagcactttgtagctgatcatctttgcactgccatttgatgaacatgttggtaacggttgcctgccttatgtagcatgaacagttgattctgacaatcaagatcctctgcctgctgcagtggtccatacatgaacagctccccttcagcgccccagctattccaggactcttctccattgtaagaagacaaaaatgtgtctgagatctcatttatgagacaagatcacagcagccactgatataacaaaagtttaggcatttttctcaacacaaagactatcgctggaagtggcacttgctacctggtgcatctttgaaaagtgtgcctttagaaacaagacacccttttaaagtaatatgttccagtggctcataagagcctccatttatatttttaaaactgttgtcttaaaaaaaaagaaatataaaaaagaaaagggcgcgcaaaaaagggggcggaaagagtaacggaggtcaaaccgcaggtgagatatcgcctggg

SEQ ID NO: 65856 - DNA, 810 bp, Homo sapiens
gacggacctaccactggccctgcgtatgtggtgcagcctctcttcaatccctaagaactggttctttcaaagcatgtattttctgaagaaactttagaaccacgtttattttaaaagaacgaattggagaaaacaaatcgattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaaatcgtttttccattctgaacctgtgctttcaaatgtgagaataaaagatctgtctgctactggcatgaacagttgattctgacaatcaagatcctctgcctgctgcagtggtccatacatgaacagctccccttcagcgccccagctattccaggactcttctccattgtaagaagacaaaaatgtgtctgagatctcatttatgagacaagatcacagcagccactgatataacaaaagtttaggcatttttctcaacacaaagactatcgctggaagtggcacttgctacctggtgcatctttgaaaagtgtgcctttagaaacaagacacccttttaaagtaatatgtcttcaaatgttgtgacttacataaagtagctctttcattacttatatcatttttattaaaaaaacttaagttagactctttttctgtctgttgagtgatttattt

SEQ ID NO: 65857 - DNA, 893 bp, Homo sapiens
gacggacctaccactggccctgcgtatgtggtgcagcctctcttcaatccctaagaactggttctttcaaagcatgtattttctgaagaaactttagaaccacgtttattttaaaagaacgaattggagaaaacaaatcgattaatgctcacagcttcttgggtgctttctcacgggtaaagccatggcatccgtaccttccattggttgccttctagccagaaatcagtattatcgaaagtccagtgtttcttcagttagttctttaactagctctgattctgttaacttcatagatgacgacaaaccacagcaagggttgcctgaagtggcagaatccacctggtggtttaaatcgtttttccattctgaacctgtgctttcaaatgtgagaataaaagatctgtctgctactggattacagatgagcactttgtagctgatcatctttgcactgccatttgatgaacatgttggtaacggttgcctgccttatgtagcatgaacagttgattctgacaatcaagatcctctgcctgctgcagtggtccatacatgaacagctccccttcagcgccccagctattccaggactcttctccattgtaagaagacaaaaatgtgtctgagatctcatttatgagacaagatcacagcagccactgatataacaaaagtttaggcatttttctcaacacaaagactatcgctggaagtggcacttgctacctggtgcatctttgaaaagtgtgcctttagaaacaagacacccttttaaagtaatatgtcttcaaatgttgtgacttacataaagtagctctttcattacttatatcatttttattaaaaaaacttaagttagactctttttctgtctgttgagtgatttattt

SEQ ID NO: 65858 - DNA, 177 bp, Homo sapiens
acaagccaggaataaatgatttcaaaccatgctacttgacagtttgtatataaatgatgcggatttgcttgtctggttgccagttatttatttgtttaatatcatttgtttcctacagagtccagtgtttcttcagttagttctttaactagctctgattctgttaacttcatagat

SEQ ID NO: 65859 - DNA, 2759 bp, Homo sapiens
ttttttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggctgcctcctcctggacagcgcgatggggcccttctgggcgagaaaggatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccata

SEQ ID NO: 65860 - DNA, 347 bp, Homo sapiens
  misc_feature (43)..(43): n is a, c, g, or t
  misc_feature (340)..(340): n is a, c, g, or t
accacctagcatatttcctattctgatggagagaaactccatnccaagcagctgtactttttcaacttgaaaatctccaaggaaaagagccttttccttctgttgactaaggtttagatgcagaccagggaatctttcctgtcacttggctgtttaaaaccggaggtatcttcaaaggcatggagacctggttccagtaaatgtcccaccagtggggtatagaaagcatgctcatgaccctgccgtgtcgtctgaggggcttctttacttaaacctcatgaaccaacctcttctagtttcaaatgattcttctgcagctttgtcacctctcccagatttnagaaaat

SEQ ID NO: 65861 - DNA, 2852 bp, Homo sapiens
ggcggcgcgttggagcctcaccaagagccgccgcccgcagcccgcgccggctcagcgcagtctcctcgctccgtgctcgcaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccata

SEQ ID NO: 65862 - DNA, 3002 bp, Homo sapiens
aacattaggtcaccgagagagacagcagctcttgctcacacagctgataggattaggagatggtgctttgtcagccctgattgagcccaagaaaaccccctgcatacacaggcatcaacaaatattgactggatcatctggacctgacttagctgccctttggaaagttctgttcaatcagctggatagagctgtttgttttcctcacctaaccctcacagctatcctagaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccata

SEQ ID NO: 65863 - DNA, 2416 bp, Homo sapiens
tgagactgtactctactgagatatgagctgcacacactgtatttctgcaaaagacataccccagcctgtgctgggaggctgtttgcagaggcaatgtttgccatgaaagtctatggagcttaccttctaagtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccata

SEQ ID NO: 65864 - DNA, 520 bp, Homo sapiens
tctgagcgccgactccatgaaaggtgaatctgccttccttgaacggtggggtgtaggacaacttctttctccataaaatgaaatatgaacccaaactatagaaagatagaaaagaaaaaatgattgtattcaattttggtcaaatttttaaagtcagcctctgaaaagagtcatttcataactctgtgtgatatggctgtttcaggagttcagggaggcccgtaggttagaggggaacctttgtttttcgttgttgttgtcgttttttgttgttgttgttttgcagtgtatacagctttgatgtgaaataatcaggtgtgtgcatgactatttttaaatggcaaaaacacgtgcgggaacaatcccatacttccagcagaatgggtcacaaccgtggaccaattaagccgtgtttatatccgtgcatgaatggatatctgtgtgcattgtgattcctgcatgctatttctgtgccgaaggaaggggctcattgttcttggccaagtgttaaggctgaaaa

SEQ ID NO: 65865 - DNA, 2647 bp, Homo sapiens
ggcggcgcgttggagcctcaccaagagccgccgcccgcagcccgcgccggctcagcgcagtctcctcgctccgtgctcgcaggtgcctcctcctggacggcggcagcggcggcgcgaggagccggcgggcagcggcgcgatggggcccctccgcgagagcaagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccata

SEQ ID NO: 65866 - DNA, 3045 bp, Homo sapiens
ttttttgtcctcagccccagcagccgcccggctggctgcagaggccgaggggccgagggcaccggagcgcaagggattccgcggcaccacgtgtccaagccgggctaaggcgggcggagcgggccgggcccggctccccgggcctgagcgcaaaccagcagcgacgcggggtcccgtccgcaccggcacccggcccagccggggcccggtctcccgggcgcacgtaggctgcctcctcctggacagcgcgatggggcccttctgggcgagaaagggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccata

SEQ ID NO: 65867 - DNA, 3068 bp, Homo sapiens
ggcggcgcgttggagcctcaccaagagccgccgcccgcagcccgcgccggctcagcgcagtctcctcgctccgtgctcgcaggtgcctcctcctggacggcggcagcggcggcgcgaggagccggcgggcagcggcgcgatggggcccctccgcgagagcaagaaggagcacagagtgcagcatcatgacaaggagatttctcgaagccgaattccccggttgattcttcggccccatatgccccaacaacagcacaaagtgtccccagcctctgagtctcctttctctgaggaagagagcagagagttcaaccccagcagctctgggcgctcagcgaggaccgttagcagcaacagcttctgctcagatgacacaggctgtcctagcagccagtcagtgtctcctgtgaagacaccctcagatgctggaaacagccccattggcttttgccctggaagtgatgaaggcttcaccagaaagaaatgcacgattggaatggttggtgaaggaagcattcagtcctctcgatataagaaggaatcaaagtcaggccttgtgaaaccaggtagtgaagctgattttagctcctcgagcagcacaggcagcatttccgctcctgaggtccatatgtcgactgcgggaagcaagcggtcttcttcttcacgcaatcgaggtcctcatgggcggagtaatggagcttcgtcacacaagcctggcagcagcccatcatccccgcgggaaaaggaccttctgtccatgctgtgcaggaatcagctgagccctgtcaatatccatcccagttatgcaccttcttccccaagcagtagcaactcaggctcctacaaaggaagcgactgtagccccatcatgaggcgttctggaaggtacatgtcttgcggtgaaaatcatggtgtcagacccccaaacccagagcagtatttgactccactgcagcagaaagaggtgacagtgagacacctcaaaaccaagctgaaggaatctgagcgccgactccatgaaagggaaagtgaaatcgtggagcttaagtcccagctggcccgcatgcgagaggactggattgaggaggagtgtcaccgggtagaggcccagttggcactcaaagaagccaggaaagagattaaacagctcaaacaggtcatcgaaaccatgcggagcagcttggctgataaagataaaggcattcagaaatattttgtggacataaacatccaaaacaagaagctggagtctctccttcagagcatggagatggcacacagtggctctctgagggacgaactgtgcctagactttccatgtgattccccagagaagagcttaaccctcaacccccctcttgacacaatggcagatgggttatctctggaagagcaggtcacgggggaaggggctgacagggagctactggtaggagatagcatagccaacagcacagatttgttcgatgagatagtgacagccaccaccacagaatctggtgacctggagcttgtgcattccacccctggggctaacgtcctggagctgctgcccatagtcatgggtcaggaggagggcagtgtggtggtggagcgagccgttcagaccgacgtggtgccctacagcccagccatctcagagctcattcagagtgtgctgcagaagctccaggacccctgtccctcgagcttggcgtcccctgatgagtctgaaccagactcgatggagagcttcccagagtccctctctgccttagtggttgatttaactccaagaaatccaaactcagccatccttttgtctcccgtggagaccccctacgccaatgtggatgcagaagttcatgcaaaccgcctcatgagagagctggattttgcagcctgcgtggaagagaggttggatggtgtcatcccactggctcgcgggggcgtcgtgaggcagtactggagcagcagcttcctggtggatctcctggctgtggctgcccccgtggtccccacggttctgtgggcattcagtactcagagagggggaacggatcctgtgtataacatcggggccttgctcaggggctgttgcgtggttgccctgcattcgctccgccgcaccgccttccgtatcaaaacctaaatagaagttgttgttaccgtgtgccaatgtgtcccatgtgggttgtgccaggtagagaaacaggaagtcaatcatctgtgacagtctctattctgtcgttttgctccttggtatttgatttgcactatatttagttgaagcctgttcactgtttaaaaccggaggtatcttcaaaggcatggagacctggttccagtaaatgtcccaccagtggggtatagaaagcatgctcatgaccctgccgtgtcgtctgaggtacccgttcttatcctagtggttcaggaagagaaaacgcagtttgcactttcaagacagcttctctaaggctggcatgttatctccttgctttgctttttgccgttttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgttaattgatgaaactgtgcataagtttacaatgtactaacttattttgcttattatatatagtgttttattggaaattgtaaccacacacttcagcatgatgaaaataaagattagtgtttccatttaaataaatgttttatcctcccataaaataataattatttctgtgattttacttctatgtataagaaagacaatgaatagcagatcttacatctttatcaatagggggtctgtaaaaattgaattaaattaggaagagggaaaaagagttagttattaaagaaaatgaagatttcctacccttacttaaaaagcatcatttctgaataaaagtagatttgtttacttttaaattgcccata

SEQ ID NO: 65868 - DNA, 316 bp, Homo sapiens
gatcttccctgtcctacatttggatattgccttaaggaaggaaaaaaaaaaaaaaaagcagggctttccaattttgcaattttgtgtttgggagcagaatgaatactgatcctgccttccatgagccagctaccctcatctgataagcatggatgagacaaggatgctagggcctcacttatgtaactgtacccaaaggatttacgggcaccatcatgttgaagcccccagagcaaacttttctttctcaacacaggctacactcctgggaaacacatgacggcaggttgcacccaccaccaagataaagttaact

SEQ ID NO: 65869 - DNA, 539 bp, Homo sapiens
cgttttcaaatataacttttcttttctttccgtaacttctatgtctttttaatgtggacaaattaaattatgactgaaggagtgattctaagggtggcaccaaatgtcaggcaatttttgttttgttggtttatgcttcaatatactttgttgatttctaggctgacttatattcagtaaaattgtatgccttactacaaggtgacgtaccgggtgcagtttatttttgagataatattggcaccttctgtacctcataattcgcagaacttattcatagtctgtataatgcataatgatctgcctcatctagagttatccagtatagtacccactagccacatgacatgtgactattggcaagtgaaacgggctagtctgaattgacatatgttgaatatgtaaaatacacaccagatttcagtgagcaagcatgacaaatacaacacaaaaagtctcagtgataatttttgaatatttattaaatgttaaaatgatatttttaatatattggattaataaaaatatattattggaat

SEQ ID NO: 65870 - DNA, 491 bp, Homo sapiens
ttgggatgacgttatataacactttcatggtacttaatgacttcagtgagatgtaagtaacacattttgaagcagctcacttcggttgaaagaattatttttcaacctggagttgatttcttcaatttcgcatcattcctagcaaattgtaacattaaggtcatattatttgtccagtcttttctaaatgctgtaacgttttgtcatgaaatcatgggaaaatgttacttttgcattgtgaggagtgagtaggaatttgtttaggacagaaaaccaaatcttagaattgtggactttgcttatgacttctacctctttagttaaaatcaaagttgcgcagttacctgtttgagttgcataaaacagttctgtgggatgatcctctcaaccatggttatccagccttttggcttccctggaccatgttggaagaagaattgtcttgggctacacataaaatatgctaacactaatgataactcatgagctta

SEQ ID NO: 65871 - DNA, 2467 bp, Homo sapiens
  misc_feature (1404)..(1404): n is a, c, g, or t
gcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaagggcgtatccatgctccaggacagctggagcagtgtaatttcctatcaaaangtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccaaaaaatttatt

SEQ ID NO: 65872 - DNA, 2416 bp, Homo sapiens
gcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaaggtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccaaaaaatttatt

SEQ ID NO: 65873 - DNA, 2709 bp, Homo sapiens
  misc_feature (1646)..(1646): n is a, c, g, or t
attccagatcccttgacttgcttgcggagggagcggccggcggagggagcggcaggtggagggagtggcacgaggcatgcggagggagctgcaccgacatcacataaacgcactgggcagctcgcaggcgccattcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccggccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaagggcgtatccatgctccaggacagctggagcagtgtaatttcctatcaaaangtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccaaaaaatttatt

SEQ ID NO: 65874 - DNA, 403 bp, Homo sapiens
gacctgtttaccattaaacctctggatgtcgccaccatcgtctccagtgcaaaagccacagagggccggatcattacagtggaggatcactacccgcaaggtgtgtgtgggcattgagaatgctttggaaggttttggtgtttttgtttccttgattggccacatggcatgctctcaggcatcacctatagtctacctctcacccagcatggctttgttatttgatgttcactaagcgtggggccatactcatacacatctgtgtgtccccaacagagtgcacagtgcccagtcaccagggcgggtcagtggcaacacagaggagtggctattgcaggcaagcgaggtgtcatgaaaagcatcgcagtttctttgggtttggaatgatgaatagtatgcccca

SEQ ID NO: 65875 - DNA, 2250 bp, Homo sapiens
gcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctaattgggactttaaccaggacatctgacagtgaggttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatattttctctctctctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcacactttcagtctc

SEQ ID NO: 65876 - DNA, 1889 bp, Homo sapiens
cagcagcccccggtctccttggtctgcctctttcagggtggaactcctgttgatgagctggggcaagggtgatcagggccccacttttcttggcagcaccacgcccaaggtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctaattgggactttaaccaggacatctgacagtgaggttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatattttctctctctctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcacactttcagtctc

SEQ ID NO: 65877 - DNA, 1658 bp, Homo sapiens
taatgatgcatatgcaattcttggcatctttgtatatgaaagcaaaactcaggaaaagtcaatatttaggaaataaacctatcctttatttatatattttgagctgaagatgtgaaaaagtgctgaagagtttgtacacaaccttttatcaattctatgataaaaatgtacaagaggcatgacaatgagagatggctgaattagtaaagaagtagtgtagtactgaagtctgaccatccatttgttcacagtaggaaatagtaattaacatgtgattaaaggcaatgaatttgaatgaactgaaatgactttttatctttatttttatattttaatcttcaaatagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctaattgggactttaaccaggacatctgacagtgaggttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatattttctctctctctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcacactttcagtctc

SEQ ID NO: 65878 - DNA, 2217 bp, Homo sapiens
gcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctagttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatattttctctctctctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcacactttcagtctc

SEQ ID NO: 65879 - DNA, 1096 bp, Homo sapiens
ctagaaatgcttcatctcactggtacttgtttatttatgtgtatttgtgttctatttaggttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggggaattctaaaaagaacaagagtcgatagttttgaaatagctggttggcgactgttctttccagacctgctcctgctgcacagagccgcagggctgagaccacgtccatgctggctgccttcaggaagctaaagtattgttggacctagtaaactagtcagtgttggaaacggccttgaaatatttaaaacatatttgtaaccagtgaggcaaatacagaagttgatgtcggcagtaaatggaaaacaatacgtatgtcatggatattgtaggtttccttatgctgtttttactgtgcactttttaaaattaggttttaatttcagtatgtaagaacaaatattttgtatactttcaaactcaattatatggtaatcgatttggtatctatggaatagatatatgtttctggaaaaaaatgcttaaattgtcaaactgtcattacttcttattatagttgaaggcattctccagattctttttaaaagatttgttcatattttctctctctctctctctctctctctctctctctctctcttctttctctctgagggagagggagccctccaaacttcagatcctgtgggtttagtatcattatcttcagctctttgataccctgtgttagagtaatagctaaaggaagttcatgtcaataaattcatacttatatcacactttcagtctc

SEQ ID NO: 65880 - DNA, 1788 bp, Homo sapiens
gcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaagatatttccaaacattatagtcaaaaagctgcaatagagcatgaacttccaacagcaacacagaagctgataacaactaatgactgtatcctgtcatcagtagtggcattaacaaatggagcaggaaagattgcatccttcttcagcaacaatttggactacttcattgcttcactgagctatggacctaaggcagcgagtggattcattagtcctctttcagctgaatgcatgctacagtataagaaaaaagctgctgcctatatgaagtctttgagaaagcccctcttggagtctgtgccttatgaagaagcactggcaaaccgccgcatccttctcagctctactgaaagtcgagaaggccttgcacagcaagttcaacagagtttggaaaagatttctaaactggagcaggaaaaagaacattggatgttggaagcacaattagccaaaatcaagctagagaaagaaaaccagcgaattgcagataagctgaagaatacaggtagtgcccagctggttgggctggcccaggaaaatgctgctgtgtcaaatactgctggccaggatgaagccacagctaaggctgtgttggagcccattcagagcaccagtctaattgggactttaaccaggacatctgacagtgaggttccagatgtggaatctcgtgaagacttaattaaaaatcactacatggcaaggatagtggaacttacgtctcagttgcagctggctgacagtaagtcagtgcatttttatgccgagtgccgagcactgtctaaaagactggccttggctgaaaagtctaaggaagcattgacagaagaaatgaaacttgccagtcagaacatcagcagacttcaggatgagctgacaactaccaagaggagttacgaggatcagttaagtatgatgagtgaccacctgtgcagcatgaatgagacattatctaaacagagagaagagattgacacactaaagatgtccagtaaggtatgtgaggtgaggtgaggtagtctctctgcaatataatatttaatgtgaggtattttattgttatgcatttcaggaggaagaggacataagatttaaagtgtttgtaagggccaggggcagtggcttaagcctgtaatcccagtactttgggaggctgaggtgggaggatcccttgaggccaggagttggagagcagagtgggcaatatagtgatacttcatctctac

SEQ ID NO: 65881 - DNA, 904 bp, Homo sapiens
gcgagatattgctgggcaggccctggcttttgttcaggatcttgtgacggctcttctaaactttcatacctacacagaacagaggattcaaatttttcctgttgattctgccattgacactatatctccattgaatcagaagttctcacaataccttcatgaaaatgcgtcctatgtccgccctcttgaggaaggaatgcttcatttatttgaaagtatcactgaggatactgtgactgtcttggagacaactgtgaaattgaaaactttttcagaacacttaacctcctacatatgttttcttaggaagattcttccctatcagttaaaaagtttagaagaagaatgtgaatcctctctttgcacatctgcgttaagagccaggaatctagagctgtcccaggacatgaaaaaaatgacagctgtgtttgagaagctgcagacttacatagctcttcttgccttgccaagtacagagccagatggactccttcggacaaactacagttctgtgttaacaaatgttggtgctgctctgcatggatttcatgacgttatgaaaggtaggccttgaaaaagaacgtaagcttaaaacctttgccccactttcttcgatctgcctgaataagatttaaacaaacactgccaagggtaatagaccccagataaaggcttattagcatttggcttatgttgagtgcacagctcactgccttctgcttttcccatctgttttatttctggaggtaaacaaagtgctgaagagaaatccttgtgtacagtccttgtgtacagtactttagccagaaatacgttacactgactttaggcaggtgtgtgaattgtacaaaaccagacatgctattcagaggccttttgcaaaatacgttgcgcttcttagagc

SEQ ID NO: 65882 - DNA, 300 bp, Homo sapiens
cttgagcacaggagtttgaggctgcagtgagccattatcaggtttacaatttaggtttataatttggtgggtccatttagaaatgtgttgatgtttgttattttccagtgatttaattcacaatactttccctcctgtttagttctcacaataccttcatgaaaatgcgtcctatgtccgccctcttgaggaaggaatgcttcatttatttgaaagtatcactgaggatactgtgactgtcttggtaattttcttccttgttttacttctggaaactgggagctcctctttgtccagtag

SEQ ID NO: 65883 - DNA, 2247 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatat

SEQ ID NO: 65884 - DNA, 636 bp, Homo sapiens
ttctccaatggacatctcttccacagacctcaacgtgagaactgctctagtttctataaactgtaaacctgtggtggtctgattatcctgatattggattttcttgttttctgttacaccttgagtcatttgcctttaggattctagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccgctctttttttacttataacctagggatacctctaggaaca

SEQ ID NO: 65885 - DNA, 289 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaagacaaggtctccctctgtcaccc

SEQ ID NO: 65886 - DNA, 2323 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagaggggcaaaacacaccttttgaggtctgtggagctcaaaaatgaagtcaaaggtgactgggtgacacaaacagctcagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatat

SEQ ID NO: 65887 - DNA, 2130 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttataagtaattttaatgggacactgctacaccccttcatgtctgcatacttgtttcatga

SEQ ID NO: 65888 - DNA, 1550 bp, Homo sapiens
gatcggtatagggtcatagctgttccagagtaccctcagtatacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65889 - DNA, 1784 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcgggggatactctagaatcagctaacacccaagcaccgtcc

SEQ ID NO: 65890 - DNA, 1404 bp, Homo sapiens
taaattcgcggccgctcgaccttacaacagctcctgatccccttttaaagacctccccctttcttcctccatgaccccagcatccagcagcagtcggccagaccgggagacccgtttgttggaagtgacgaaggacgccatgcggcatgcttgtcattcacagacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65891 - DNA, 1104 bp, Homo sapiens
ttctccaatggacatctcttccacagacctcaacgtgagaactgctctagtttctataaactgtaaacctgtggtggtctgattatcctgatattggattttcttgttttctgttacaccttgagtcatttgcctttaggattctagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65892 - DNA, 1455 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggatctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65893 - DNA, 810 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatccccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65894 - DNA, 622 bp, Homo sapiens
catattgcttgtctgaccttgcgatctctgaatgcttggagcttctctcgtttggacctgtcttgtggttttcacgctaaatgacgggctctcctttcgatttatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65895 - DNA, 1052 bp, Homo sapiens
  misc_feature (759)..(759): n is a, c, g, or t
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgagggncggccacactggcggaagagcgggaatccgtgggcccactgcgggaggacttctgtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgtacaagatgcagaaccatggctatgagaacccctacctacatacctggagctaattcgctggggatcctctaggcaac

SEQ ID NO: 65896 - DNA, 894 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggtactaaaactccctgcggcgtttatagaggaaggcactcttgcttagttttgtttttattacacataaaatagcctggcttatgacctcatgaagatggctctgaaaaacctgtgacttgtccctaggcacatccaggacacatggggtacaaactgcagccctcagaagtaatgctcccctcatcccatacactcttagtccttcaatttcctataaatgtggtattctaagaagttccctaggtgttaccggggaatagaaactcagttgttctgatgctataaactttggtcaaatttatctcccccccaaaaaggtagtcagaaatacctgtatttattacaacctttacgtagggagctgtttacaggaatggactttgttggagcgtcagatgaaaaagaggcactcagcttccctctgcctgttgactttgcagcctctcagtcttctatatttttcttacgctgatgctccattcttccagcatttatagtttcctcaagctgttcagtagaaccagg

SEQ ID NO: 65897 - DNA, 467 bp, Homo sapiens
ttgaccttatatagggaagggagggggtgcctgtggggtttttaaaaaattttcctttgcagaggcatttcatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65898 - DNA, 2280 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65899 - DNA, 2228 bp, Homo sapiens
ctctagaggatctcgcgtttaatccgtaccaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65900 - DNA, 2233 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65901 - DNA, 2226 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgaggggcggccacactggcggaagaggaatattgaaggcaaacagtacctcagcaacatggggactcgaggctcctacctgctgcccggcatggcgtccttcgtcacttccaacaaaccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggatctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65902 - DNA, 2061 bp, Homo sapiens
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggacctccaggtcaccatcaaagaggagagcaatccggtgccttacaacagctcctggcccccttttcaagacctccccctttcttcctccatgaccccagcatccagcagcagtcggccagaccgggagacccgggccagcgtcatcaagaaaacatcggatatcacccaggcccgcgtcaagagctgttaagcctctgactctccgcggtggttgttggggcttcttggctttgttttgttgtttgtttgtattttatttttttctctctgacacctattttagacaaatctaagggaaaaagccttgacaatagaacattgattgctgtgtccaactccagtactggagcttctctttaactcaggactccagcccattggtagacgtgtgtttctagagcctgctggatctcccagggctactcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctt

SEQ ID NO: 65903 - DNA, 1217 bp, Homo sapiens
  misc_feature (924)..(924): n is a, c, g, or t
tgctctccttgttttgctttcgatctggactgttctcaggcaagccggggagtaacttttagttttgctcctgcgattattcaactgacgggctttcatttccatttcacacaccctagcaacacttataccttgcggaattgtattggtagcgtgaaaaaagcacactgagagggcaccatgccggtggaaaggatgcgcatgcgcccgtggctggaggagcagataaactccaacacgatcccggggctcaagtggcttaacaaggaaaagaagatttttcagatcccctggatgcatgcggctagacatgggtgggatgtggaaaaagatgcaccactctttagaaactgggcaatccatacaggaaagcatcaaccaggagtagataaacctgatcccaaaacatggaaggcgaatttcagatgcgccatgaattccttgcctgatattgaagaagtcaaggataaaagcataaagaaaggaaataatgccttcagggtctaccgaatgctgcccctatcagaacggccttctaagaaaggaaagaaaccaaagacagaaaaagaagacaaagttaagcacatcaagcaagaaccagttgagtcatctctggggcttagtaatggagtaagtgatctttctcctgagtatgcggtcctgacttcaactataaaaaatgaagtggatagtacggtgaacatcatagttgtaggacagtcccatctggacagcaacattgagaatcaagagattgtcaccaatccgccagacatttgccaagttgtagaggtgaccactgagagcgacgagcagccggtcagcatgagcgagctctaccctctgcagatctcccccgtgtcttcctatgcagaaagcgaaacgactgatagtgtgcccagcgatgaagagagtgccgagggncggccacactggcggaagagcgggaatccgtgggcccactgcgggaggacttctgtctgagtagcagtgctctcattggcctgctggtcatcgcagtggccattgccacggtcatcgtcatcagcctggtgatgctgaggaagaggcagtatggcaccatcagccacgggatcgtggaggttgatccaatgctcaccccagaagagcgtcacctgtacaagatgcagaaccatggctatgagaacccctacctacatacctggagctaattcgctggggatcctctaggcaac

SEQ ID NO: 65904 - DNA, 4983 bp, Homo sapiens
cggacgcgtgggtcgacccacgcgtccggagacaccgcggaaccctgcagatgctgtggccgacccggcagtgcgggccagagcccctccgcccccatagccacaattcagtagtcgtagggtaggtttgagctactaagcaaataccacactaaccactttttcgataattaaaagaatcatttgaaatattttttttaattgaaaaagatattttaatttcagctcttttattctgcaggtgtattattctgcatgtttttaaatgatataaaacatttatatagacaataagcaacttagaaaaaataagattttgcatttctaaaattataattgaaaacaaaatctgacattctctgctaagtcttatctgaatgcttcagataatggtagtgtagtcagtgactaaaatatttttatcaaatttcctctctgtagacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccctgctcgtcccgtctgaaggactctcctaggaggccaggttgcccctccagacccctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaaggaacgactgtttaatgtacttgatgggcctctggtcttgccgtgtctcctgccgctggtggcactttgtagattgtgtgtttgtgtccgggtggcagttgggtacctgctcacgcacggtgtgtctgccaggccacggtgtcccaggatcgcagagggctgactttcaagacttcaagaacattttctggatgtgtggaaacttgagaatggccttgtgaatctcgtgcttggacagggcaagtccgactactgaaagtgctgccagctttgctgcgagccctccggccagcgggagccccgtgggctgggcactgtggcccttcttctctgggggacggcacccctggcttcctcacctcggccgggcgtccgtggcagctcactctatgcaacttgatcctctagcggctttaagactgtagatcccctctctgagacctggctgtacttgtcaggatctcgaggcgcagctcccgtcttagctggtttctccggcttctcgtcctgacgactataaaacagttggaggcaagaaagcagcggatgtggggtggcagtggcctgacccgaatcaagatccgacccaaaccacaccaaatgtgggttcatctgggggccaccccttgcctgaggcttcccaccctcatctgaaggcccaggggccggatccagggctcaccaaagccgattcctcgccagctgggagtgcagaagtctcagggcctggctgcgacttgatttttaggaggaagaggggcttcgcaacccccctctgaatagtgtgttaacccttgagatcccagcctcgactaatctgaagtaaggacaacaaaggccattcagtgccctccacatggccttgccacagtcactgtcagggtatgaacgtgccggaagccagtgccagccagggacaggcgtgactgttgtgtgctcctcggtgacaggagtcggtggctgcacactttgtagactcgtcaagctgtcagcacttcaggtgtttgcaagcaaagcccttcttagtgtgcaggtcagtgtgcagagcccaaatgaggggaccgcaggggctggggtccagggtcagtagagtcggtttctggagctgccttcctgggaggcaggtgtgggtgaccggggctctggcggtgcgtgtgggcccggcctggccacagcggggaccaggtcacgacatctttggcctcaacccctcccctgcactgagattatttccagattgcactcacttgaaaccgtccgtgtcgtcaccttgtgtcttaagggaagccgagaagaagggcagacgggcaggctgtcttgtctgcaaagcgccattgcgcccgcagcttgtgtgggtcaggctgcagctcgggtgtctgtggcttctaaccttgtacctcagacggatgcagtaacaaggcggggctggggacgccggtcagtgtcaaaggggaggtgctctggctgatagccttgcccgagagggacgaggaggccgtgcgggtgccccctggggaagctggccagccatccagtgctgaggacgcagctggagttgggctcgtggcacccttggggtgtgggctgtgcaggctggtggcctgggtgcctctgcacactgagtggagtgtcaggcagggtgtgtcggttggtcgagtcttgtgtaatgtgcgcagaccagttaccaaactaggataatgttggtctcatttgtggtggttttgttccctatacaagtcagctaagtaaagactcttttaacgagcttccccttaacacatggcagaagtttccaggtgcaggaatgcgagctggcgggaaggggcagaggccgtgagctctcagctgggccggcctgcctgtgtcccctttcctgggtctgtcggcagactggcatcatgacgttccctggtggctgaagagctagctttggagtgttgtttttctcactctcaggcaggggccttagctggaatcctccaacctgccactgaacacgtcagtgctgtgtgctgcctcttggacacctgcccttgaaagcctcaggcccctgggagaagcactctgtccagtcctgtccccgggggggaggcagggccactgagccctcctcagatggttagtggcttccaacagccatcaggagtgtttcttgaatgccccaggtgtggaggacttggtctgtgaccacctagaaccccagagctgaacaggaagccgtccctgcagcaacaagagggctggaagggggagctgcaggccaccctcggctctcccactgctggggcggtgatgttcgggtgacatgtttgaaaaatactcttaaagataccaactgttcccttatatggctaatggtttgtgcagccaccagcgatggcggcccctattagagaccaggtttgttaaaacaccaaatattgctgtccacactagacattaaccggcttcagaaaagatggacaccttttcccacgctgtttcgcttcttaactttggtccagctttagccaccacacagcgtgtgagggactgctgctgcggagtcagcctcgtttgtccctccgcctcccaccagcacgcgccgcttctgagagacaccagctccctgcctccaagcctggtgccacaggcctgtcgtgagggacccctgcttccgagagctcctgggggggttctgcccttcaccacctgggagaggtgtcagttcagttccgagttgaacaaggcccgtgcacacagcatgttgggggcccagcccaaagttcttgtcacctcctcatgcaaagccagccatcaccctccggccagagctcaaggtggccccttggccagcccctccttgggtcctccaggaggactgagcacccctcctagcggcatcccttgccctccacagtgctgccaggggcacgtcgctctgtgccgtggactgagaccatcccctggtgacagaatgacccgtttgttggaaatgcctcgttgccagagaaactccccaggcatctcggaacgaaactatttagttccattgtgaactggccacgggacagctttttatcaacttattaagttggagcactgtaatcgcgcttgctgagttagcagtggtggtaagcgtgtgttaaacacataatgttacgttttaggagagagaggtcgtaaggaagtgtcgtgtcgctcatgactctcttctattagttgggtaacagtggcctcatgtttgtgtctgtgtgtacacagagcccttaggttctgctctgtttctttgccaggtgaatgtttgtggcatgcgctgctgtccgcgcccctctgtcctgcgcagggttcagctgtgcggcgccctgatttcctccatgcacacagaacctccttgtgtctgtttctctgttcctctgtggctgactcaataaacttttccctctgacatgatgaaaaaaaagtg

SEQ ID NO: 65905 - DNA, 6850 bp, Homo sapiens
  misc_feature (959)..(959): n is a, c, g, or t
ctgagaggctttctgatggaagggcggggacttcaggagcggccctcccttgttgagatggggtgctctgacagcacctttaactttaaagacctccagggcccagccctgacagccacagtgggtcttatttgagtcggtgatgcagaaacagaggcctgtgcttcttcagcttctgggaaacctacttccaagagtctactcaccgggccggctgtgttgtggaaaatagtctaatgcggcctctgacatgtaattcatttaccgagagccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccatcggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcnttgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctctccatgctgaagatgcccagggagctgatgcggctgtgcctctgccacctcctcacctggttctctgtcatcgccgaggccgtgttctacaccgacttcatgggccaggtcatcttcgaaggcgaccccaaggccccctcgaactcgaccgcctggcaagcctacaacgccggggtcaagatgggctgctggggcctggtcatttatgccgccactggtgctatttgttcagccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcagtacatccaccacagccccgggaactccaagcgagggtttggcatagattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccgacgtgtcagaggaggccaaggaggagcagaaaggcctgtcttccccgttggccggcgaaggcagggccggcgggaacagcgaaaagcccaccgtgctgaagctcacgcggaaggagggcctgcagggaccggtggagacagagtccgtggtctgagccgcactcccgtttacacacattccagcgggcgggtgggcgggcgggcgggcggcggggccaggccatgggcgggagcagagacaccgcggaaccctgcagatgctgtggccgacccggcagtgcgggccagagcccctccgcccccatagccacaattcagtagtcgtagggtaggtttgagctactaagcaaataccacactaaccactttttcgataattaaaagaatcatttgaaatattttttttaattgaaaaagatattttaatttcagctcttttattctgcaggtgtattattctgcatgtttttaaatgatataaaacatttatatagacaataagcaacttagaaaaaataagattttgcatttctaaaattataattgaaaacaaaatctgacattctctgctaagtcttatctgaatgcttcagataatggtagtgtagtcagtgactaaaatatttttatcaaatttcctctctgtagacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccctgctcgtcccgtctgaaggactctcctaggaggccaggttgcccctccagacccctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaaggaacgactgtttaatgtacttgatgggcctctggtcttgccgtgtctcctgccgctggtggcactttgtagattgtgtgtttgtgtccgggtggcagttgggtacctgctcacgcacggtgtgtctgccaggccacggtgtcccaggatcgcagagggctgactttcaagacttcaagaacattttctggatgtgtggaaacttgagaatggccttgtgaatctcgtgcttggacagggcaagtccgactactgaaagtgctgccagctttgctgcgagccctccggccagcgggagccccgtgggctgggcactgtggcccttcttctctgggggacggcacccctggcttcctcacctcggccgggcgtccgtggcagctcactctatgcaacttgatcctctagcggctttaagactgtagatcccctctctgagacctggctgtacttgtcaggatctcgaggcgcagctcccgtcttagctggtttctccggcttctcgtcctgacgactataaaacagttggaggcaagaaagcagcggatgtggggtggcagtggcctgacccgaatcaagatccgacccaaaccacaccaaatgtgggttcatctgggggccaccccttgcctgaggcttcccaccctcatctgaaggcccaggggccggatccagggctcaccaaagccgattcctcgccagctgggagtgcagaagtctcagggcctggctgcgacttgatttttaggaggaagaggggcttcgcaacccccctctgaatagtgtgttaacccttgagatcccagcctcgactaatctgaagtaaggacaacaaaggccattcagtgccctccacatggccttgccacagtcactgtcagggtatgaacgtgccggaagccagtgccagccagggacaggcgtgactgttgtgtgctcctcggtgacaggagtcggtggctgcacactttgtagactcgtcaagctgtcagcacttcaggtgtttgcaagcaaagcccttcttagtgtgcaggtcagtgtgcagagcccaaatgaggggaccgcaggggctggggtccagggtcagtagagtcggtttctggagctgccttcctgggaggcaggtgtgggtgaccggggctctggcggtgcgtgtgggcccggcctggccacagcggggaccaggtcacgacatctttggcctcaacccctcccctgcactgagattatttccagattgcactcacttgaaaccgtccgtgtcgtcaccttgtgtcttaagggaagccgagaagaagggcagacgggcaggctgtcttgtctgcaaagcgccattgcgcccgcagcttgtgtgggtcaggctgcagctcgggtgtctgtggcttctaaccttgtacctcagacggatgcagtaacaaggcggggctggggacgccggtcagtgtcaaaggggaggtgctctggctgatagccttgcccgagagggacgaggaggccgtgcgggtgccccctggggaagctggccagccatccagtgctgaggacgcagctggagttgggctcgtggcacccttggggtgtgggctgtgcaggctggtggcctgggtgcctctgcacactgagtggagtgtcaggcagggtgtgtcggttggtcgagtcttgtgtaatgtgcgcagaccagttaccaaactaggataatgttggtctcatttgtggtggttttgttccctatacaagtcagctaagtaaagactcttttaacgagcttccccttaacacatggcagaagtttccaggtgcaggaatgcgagctggcgggaaggggcagaggccgtgagctctcagctgggccggcctgcctgtgtcccctttcctgggtctgtcggcagactggcatcatgacgttccctggtggctgaagagctagctttggagtgttgtttttctcactctcaggcaggggccttagctggaatcctccaacctgccactgaacacgtcagtgctgtgtgctgcctcttggacacctgcccttgaaagcctcaggcccctgggagaagcactctgtccagtcctgtccccgggggggaggcagggccactgagccctcctcagatggttagtggcttccaacagccatcaggagtgtttcttgaatgccccaggtgtggaggacttggtctgtgaccacctagaaccccagagctgaacaggaagccgtccctgcagcaacaagagggctggaagggggagctgcaggccaccctcggctctcccactgctggggcggtgatgttcgggtgacatgtttgaaaaatactcttaaagataccaactgttcccttatatggctaatggtttgtgcagccaccagcgatggcggcccctattagagaccaggtttgttaaaacaccaaatattgctgtccacactagacattaaccggcttcagaaaagatggacaccttttcccacgctgtttcgcttcttaactttggtccagctttagccaccacacagcgtgtgagggactgctgctgcggagtcagcctcgtttgtccctccgcctcccaccagcacgcgccgcttctgagagacaccagctccctgcctccaagcctggtgccacaggcctgtcgtgagggacccctgcttccgagagctcctgggggggttctgcccttcaccacctgggagaggtgtcagttcagttccgagttgaacccttaggttctgctctgtttctttgccaggtgaatgtttgtggcatgcgctgctgtccgcgcccctctgtcctgcgcagggttcagctgtgcggcgccctgatttcctccatgcacacagaacctccttgtgtctgtttctctgttcctctgtggctgactcaataaacttttccctctgacatgatgaaaaaaaagtg

SEQ ID NO: 65906 - DNA, 2469 bp, Homo sapiens
  misc_feature (959)..(959): n is a, c, g, or t
ctgagaggctttctgatggaagggcggggacttcaggagcggccctcccttgttgagatggggtgctctgacagcacctttaactttaaagacctccagggcccagccctgacagccacagtgggtcttatttgagtcggtgatgcagaaacagaggcctgtgcttcttcagcttctgggaaacctacttccaagagtctactcaccgggccggctgtgttgtggaaaatagtctaatgcggcctctgacatgtaattcatttaccgagagccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccatcggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcnttgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctctccatgctgaagatgcccagggagctgatgcggctgtgcctctgccacctcctcacctggttctctgtcatcgccgaggccgtgttctacaccgacttcatgggccaggtcatcttcgaaggcgaccccaaggccccctcgaactcgaccgcctggcaagcctacaacgccggggtcaagatgggctgctggggcctggtcatttatgccgccactggtgctatttgttcagccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcaggtgcgtccaccgtagccctgagatctgcgctccagcctcctgagtgccttccctccatacagagcagagccctgtgcttccccggggggacgttcacgacacagatggccctccttcctctccggttctgagatggccccttccaaagcccacagagccaccacctgcccctgatcggtccctggccacaaagggtcttctccttcagccgcccccacccccctagcacctccagaggcttctggaggcaaaagcactgtccctgcccctttggtcccctcaggcccagtcacatttccctgagggggaagctccagccccgtgttttccacttggatgggaggaaagccacccaggtatgcctagacttcctggcggccacgtttagaaagtgaaaaggccagtgaaggccattttcatagcatatttattcaacctggtgtatctaaaacattatttcagcatgtactctatatgaaaaaagtcatcgagatacctt

SEQ ID NO: 65907 - DNA, 461 bp, Homo sapiens
ctgagaggctttctgatggaagggcggggacttcaggagcggccctcccttgttgagatggggtgctctgacagcacctttaactttaaagacctccagggcccagccctgacagccacagtgggtcttatttgagtcggtgatgcagaaacagaggcctgtgcttcttcagcttctgggaaacctacttccaagagtctactcaccgggccggctgtgttgtggaaaatagtctaatgcggcctctgacatgtaattcatttaccgagagtaagtagacttgcagagaactttcttatcatcgtgtaatggtgctgtggtgttgtccttccagcattttgaactcactgcccatggatgtcatcagagcaccacggcctcgggagtgcaggcagggatctagtgtccagcgctgagctgtgcgcaccatgttctcctttaatctccataatgcccacctt

SEQ ID NO: 65908 - DNA, 7371 bp, Homo sapiens
  misc_feature (959)..(959): n is a, c, g, or t
ctgagaggctttctgatggaagggcggggacttcaggagcggccctcccttgttgagatggggtgctctgacagcacctttaactttaaagacctccagggcccagccctgacagccacagtgggtcttatttgagtcggtgatgcagaaacagaggcctgtgcttcttcagcttctgggaaacctacttccaagagtctactcaccgggccggctgtgttgtggaaaatagtctaatgcggcctctgacatgtaattcatttaccgagagccttccggagcagtactacagcctcacctggttcctgagccccatccttggcctcatcttcacacctctcattgggtctgcgagtgaccggtgcaccctgagctggggccgccggcggcccttcatcctcgccctctgcgttggcgtcctctttggcgttgcacttttccttaacggctctgccatcggtctggccctcggcgatgtccccaaccggcagcccatcggcatcgtgctcacggtgctgggagtggtggtcctggacttcagcgccgatgccaccgaggggcccatccgtgcctatctgctggacgtggtggacagcgaggagcaggacatggccctcaacatccacgccttctctgccggcctcggcggagccatcggctacgtgctgggtgggctggactggacccagaccttcctgggcagctggttccggacccagaaccaggtgctcttcttctttgccgccatcatcttcacggtgtccgtggccctgcacctgttcagcatcgacgaggagcagtacagcccgcagcaggagcgcagcgctgaggagcccggcgccctggatgggggcgagccgcacggcgtccctgccttcccagacgaggtacagtcggagcacgagctggccctggactacccggacgtggacatcatgcgcagcaaaagcgactcggcnttgcacgtgccggacaccgcgctggacctggagcccgagctgctgttcctgcacgacatcgagccctccatcttccacgacgcctcctaccccgccaccccccgcagcaccagccaggagctcgccaagaccaagctgccccgcctggccaccttcctcaaggaagccgccaaggaggacgagaccttgctggataatcacttgaatgaagctaaagtcccaaacggaagtggctcccccacaaaagacgccctcggcggctacaccagggtggacacgaagccctcggccacgtcgagctccatgcggcggcggcggcacgcgttccgcaggcaggcctccagcaccttctcctactacggcaagcttgggtcccactgctaccgctaccggcgcgccaacgccgtggtgctgatcaagccgtcgcgcagcatgagcgacctgtacgacatgcagaagcggcagcggcagcaccggcaccggaaccagagcggggccaccacctccagcggggacaccgagagtgaggagggggagggcgagaccacggtgcgcctgctgtggctctccatgctgaagatgcccagggagctgatgcggctgtgcctctgccacctcctcacctggttctctgtcatcgccgaggccgtgttctacaccgacttcatgggccaggtcatcttcgaaggcgaccccaaggccccctcgaactcgaccgcctggcaagcctacaacgccggggtcaagatgggctgctggggcctggtcatttatgccgccactggtgctatttgttcagccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcagtacatccaccacagccccgggaactccaagcgagggtttggcatagattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccgacgtgtcagaggaggccaaggaggagcagaaaggcctgtcttccccgttggccggcgaaggcagggccggcgggaacagcgaaaagcccaccgtgctgaagctcacgcggaaggagggcctgcagggaccggtggagacagagtccgtggtctgagccgcactcccgtttacacacattccagcgggcgggtgggcgggcgggcgggcggcggggccaggccatgggcgggagcagagacaccgcggaaccctgcagatgctgtggccgacccggcagtgcgggccagagcccctccgcccccatagccacaattcagtagtcgtagggtaggtttgagctactaagcaaataccacactaaccactttttcgataattaaaagaatcatttgaaatattttttttaattgaaaaagatattttaatttcagctcttttattctgcaggtgtattattctgcatgtttttaaatgatataaaacatttatatagacaataagcaacttagaaaaaataagattttgcatttctaaaattataattgaaaacaaaatctgacattctctgctaagtcttatctgaatgcttcagataatggtagtgtagtcagtgactaaaatatttttatcaaatttcctctctgtagacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccctgctcgtcccgtctgaaggactctcctaggaggccaggttgcccctccagacccctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaaggaacgactgtttaatgtacttgatgggcctctggtcttgccgtgtctcctgccgctggtggcactttgtagattgtgtgtttgtgtccgggtggcagttgggtacctgctcacgcacggtgtgtctgccaggccacggtgtcccaggatcgcagagggctgactttcaagacttcaagaacattttctggatgtgtggaaacttgagaatggccttgtgaatctcgtgcttggacagggcaagtccgactactgaaagtgctgccagctttgctgcgagccctccggccagcgggagccccgtgggctgggcactgtggcccttcttctctgggggacggcacccctggcttcctcacctcggccgggcgtccgtggcagctcactctatgcaacttgatcctctagcggctttaagactgtagatcccctctctgagacctggctgtacttgtcaggatctcgaggcgcagctcccgtcttagctggtttctccggcttctcgtcctgacgactataaaacagttggaggcaagaaagcagcggatgtggggtggcagtggcctgacccgaatcaagatccgacccaaaccacaccaaatgtgggttcatctgggggccaccccttgcctgaggcttcccaccctcatctgaaggcccaggggccggatccagggctcaccaaagccgattcctcgccagctgggagtgcagaagtctcagggcctggctgcgacttgatttttaggaggaagaggggcttcgcaacccccctctgaatagtgtgttaacccttgagatcccagcctcgactaatctgaagtaaggacaacaaaggccattcagtgccctccacatggccttgccacagtcactgtcagggtatgaacgtgccggaagccagtgccagccagggacaggcgtgactgttgtgtgctcctcggtgacaggagtcggtggctgcacactttgtagactcgtcaagctgtcagcacttcaggtgtttgcaagcaaagcccttcttagtgtgcaggtcagtgtgcagagcccaaatgaggggaccgcaggggctggggtccagggtcagtagagtcggtttctggagctgccttcctgggaggcaggtgtgggtgaccggggctctggcggtgcgtgtgggcccggcctggccacagcggggaccaggtcacgacatctttggcctcaacccctcccctgcactgagattatttccagattgcactcacttgaaaccgtccgtgtcgtcaccttgtgtcttaagggaagccgagaagaagggcagacgggcaggctgtcttgtctgcaaagcgccattgcgcccgcagcttgtgtgggtcaggctgcagctcgggtgtctgtggcttctaaccttgtacctcagacggatgcagtaacaaggcggggctggggacgccggtcagtgtcaaaggggaggtgctctggctgatagccttgcccgagagggacgaggaggccgtgcgggtgccccctggggaagctggccagccatccagtgctgaggacgcagctggagttgggctcgtggcacccttggggtgtgggctgtgcaggctggtggcctgggtgcctctgcacactgagtggagtgtcaggcagggtgtgtcggttggtcgagtcttgtgtaatgtgcgcagaccagttaccaaactaggataatgttggtctcatttgtggtggttttgttccctatacaagtcagctaagtaaagactcttttaacgagcttccccttaacacatggcagaagtttccaggtgcaggaatgcgagctggcgggaaggggcagaggccgtgagctctcagctgggccggcctgcctgtgtcccctttcctgggtctgtcggcagactggcatcatgacgttccctggtggctgaagagctagctttggagtgttgtttttctcactctcaggcaggggccttagctggaatcctccaacctgccactgaacacgtcagtgctgtgtgctgcctcttggacacctgcccttgaaagcctcaggcccctgggagaagcactctgtccagtcctgtccccgggggggaggcagggccactgagccctcctcagatggttagtggcttccaacagccatcaggagtgtttcttgaatgccccaggtgtggaggacttggtctgtgaccacctagaaccccagagctgaacaggaagccgtccctgcagcaacaagagggctggaagggggagctgcaggccaccctcggctctcccactgctggggcggtgatgttcgggtgacatgtttgaaaaatactcttaaagataccaactgttcccttatatggctaatggtttgtgcagccaccagcgatggcggcccctattagagaccaggtttgttaaaacaccaaatattgctgtccacactagacattaaccggcttcagaaaagatggacaccttttcccacgctgtttcgcttcttaactttggtccagctttagccaccacacagcgtgtgagggactgctgctgcggagtcagcctcgtttgtccctccgcctcccaccagcacgcgccgcttctgagagacaccagctccctgcctccaagcctggtgccacaggcctgtcgtgagggacccctgcttccgagagctcctgggggggttctgcccttcaccacctgggagaggtgtcagttcagttccgagttgaacaaggcccgtgcacacagcatgttgggggcccagcccaaagttcttgtcacctcctcatgcaaagccagccatcaccctccggccagagctcaaggtggccccttggccagcccctccttgggtcctccaggaggactgagcacccctcctagcggcatcccttgccctccacagtgctgccaggggcacgtcgctctgtgccgtggactgagaccatcccctggtgacagaatgacccgtttgttggaaatgcctcgttgccagagaaactccccaggcatctcggaacgaaactatttagttccattgtgaactggccacgggacagctttttatcaacttattaagttggagcactgtaatcgcgcttgctgagttagcagtggtggtaagcgtgtgttaaacacataatgttacgttttaggagagagaggtcgtaaggaagtgtcgtgtcgctcatgactctcttctattagttgggtaacagtggcctcatgtttgtgtctgtgtgtacacagagcccttaggttctgctctgtttctttgccaggtgaatgtttgtggcatgcgctgctgtccgcgcccctctgtcctgcgcagggttcagctgtgcggcgccctgatttcctccatgcacacagaacctccttgtgtctgtttctctgttcctctgtggctgactcaataaacttttccctctgacatgatgaaaaaaaagtg

SEQ ID NO: 65909 - DNA, 5693 bp, Homo sapiens
ttgactctagagcatccccctatgaaggatggggcgaaggggcctggtcatttatgccggcactggtgctatttgttcggccctgttacagaagtacttggacaactacgacctgagcgtcagggtgatctacgtgctggggacgctgggcttctctgtcggcacagccgtgatggccatgtttcccaacgtctacgtcgccatggtcaccatcagcaccatgggcatcgtctccatgagcatctcctactgcccgtacgccctgctgggccagtaccatgacatcaagcagtacatccaccacagccccgggaactccaagcgagggtttggcatagattgtgccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccgacgtgtcagaggaggccaaggaggagcagaaaggcctgtcttccccgttggccggcgaaggcagggccggcgggaacagcgaaaagcccaccgtgctgaagctcacgcggaaggagggcctgcagggaccggtggagacagagtccgtggtctgagccgcactcccgtttacacacattccagcgggcgggtgggcgggcgggcgggcggcggggccaggccatgggcgggagcagagacaccgcggaaccctgcagatgctgtggccgacccggcagtgcgggccagagcccctccgcccccatagccacaattcagtagtcgtagggtaggtttgagctactaagcaaataccacactaaccactttttcgataattaaaagaatcatttgaaatattttttttaattgaaaaagatattttaatttcagctcttttattctgcaggtgtattattctgcatgtttttaaatgatataaaacatttatatagacaataagcaacttagaaaaaataagattttgcatttctaaaattataattgaaaacaaaatctgacattctctgctaagtcttatctgaatgcttcagataatggtagtgtagtcagtgactaaaatatttttatcaaatttcctctctgtagacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccctgctcgtcccgtctgaaggactctcctaggaggccaggttgcccctccagacccctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaaggaacgactgtttaatgtacttgatgggcctctggtcttgccgtgtctcctgccgctggtggcactttgtagattgtgtgtttgtgtccgggtggcagttgggtacctgctcacgcacggtgtgtctgccaggccacggtgtcccaggatcgcagagggctgactttcaagacttcaagaacattttctggatgtgtggaaacttgagaatggccttgtgaatctcgtgcttggacagggcaagtccgactactgaaagtgctgccagctttgctgcgagccctccggccagcgggagccccgtgggctgggcactgtggcccttcttctctgggggacggcacccctggcttcctcacctcggccgggcgtccgtggcagctcactctatgcaacttgatcctctagcggctttaagactgtagatcccctctctgagacctggctgtacttgtcaggatctcgaggcgcagctcccgtcttagctggtttctccggcttctcgtcctgacgactataaaacagttggaggcaagaaagcagcggatgtggggtggcagtggcctgacccgaatcaagatccgacccaaaccacaccaaatgtgggttcatctgggggccaccccttgcctgaggcttcccaccctcatctgaaggcccaggggccggatccagggctcaccaaagccgattcctcgccagctgggagtgcagaagtctcagggcctggctgcgacttgatttttaggaggaagaggggcttcgcaacccccctctgaatagtgtgttaacccttgagatcccagcctcgactaatctgaagtaaggacaacaaaggccattcagtgccctccacatggccttgccacagtcactgtcagggtatgaacgtgccggaagccagtgccagccagggacaggcgtgactgttgtgtgctcctcggtgacaggagtcggtggctgcacactttgtagactcgtcaagctgtcagcacttcaggtgtttgcaagcaaagcccttcttagtgtgcaggtcagtgtgcagagcccaaatgaggggaccgcaggggctggggtccagggtcagtagagtcggtttctggagctgccttcctgggaggcaggtgtgggtgaccggggctctggcggtgcgtgtgggcccggcctggccacagcggggaccaggtcacgacatctttggcctcaacccctcccctgcactgagattatttccagattgcactcacttgaaaccgtccgtgtcgtcaccttgtgtcttaagggaagccgagaagaagggcagacgggcaggctgtcttgtctgcaaagcgccattgcgcccgcagcttgtgtgggtcaggctgcagctcgggtgtctgtggcttctaaccttgtacctcagacggatgcagtaacaaggcggggctggggacgccggtcagtgtcaaaggggaggtgctctggctgatagccttgcccgagagggacgaggaggccgtgcgggtgccccctggggaagctggccagccatccagtgctgaggacgcagctggagttgggctcgtggcacccttggggtgtgggctgtgcaggctggtggcctgggtgcctctgcacactgagtggagtgtcaggcagggtgtgtcggttggtcgagtcttgtgtaatgtgcgcagaccagttaccaaactaggataatgttggtctcatttgtggtggttttgttccctatacaagtcagctaagtaaagactcttttaacgagcttccccttaacacatggcagaagtttccaggtgcaggaatgcgagctggcgggaaggggcagaggccgtgagctctcagctgggccggcctgcctgtgtcccctttcctgggtctgtcggcagactggcatcatgacgttccctggtggctgaagagctagctttggagtgttgtttttctcactctcaggcaggggccttagctggaatcctccaacctgccactgaacacgtcagtgctgtgtgctgcctcttggacacctgcccttgaaagcctcaggcccctgggagaagcactctgtccagtcctgtccccgggggggaggcagggccactgagccctcctcagatggttagtggcttccaacagccatcaggagtgtttcttgaatgccccaggtgtggaggacttggtctgtgaccacctagaaccccagagctgaacaggaagccgtccctgcagcaacaagagggctggaagggggagctgcaggccaccctcggctctcccactgctggggcggtgatgttcgggtgacatgtttgaaaaatactcttaaagataccaactgttcccttatatggctaatggtttgtgcagccaccagcgatggcggcccctattagagaccaggtttgttaaaacaccaaatattgctgtccacactagacattaaccggcttcagaaaagatggacaccttttcccacgctgtttcgcttcttaactttggtccagctttagccaccacacagcgtgtgagggactgctgctgcggagtcagcctcgtttgtccctccgcctcccaccagcacgcgccgcttctgagagacaccagctccctgcctccaagcctggtgccacaggcctgtcgtgagggacccctgcttccgagagctcctgggggggttctgcccttcaccacctgggagaggtgtcagttcagttccgagttgaacaaggcccgtgcacacagcatgttgggggcccagcccaaagttcttgtcacctcctcatgcaaagccagccatcaccctccggccagagctcaaggtggccccttggccagcccctccttgggtcctccaggaggactgagcacccctcctagcggcatcccttgccctccacagtgctgccaggggcacgtcgctctgtgccgtggactgagaccatcccctggtgacagaatgacccgtttgttggaaatgcctcgttgccagagaaactccccaggcatctcggaacgaaactatttagttccattgtgaactggccacgggacagctttttatcaacttattaagttggagcactgtaatcgcgcttgctgagttagcagtggtggtaagcgtgtgttaaacacataatgttacgttttaggagagagaggtcgtaaggaagtgtcgtgtcgctcatgactctcttctattagttgggtaacagtggcctcatgtttgtgtctgtgtgtacacagagcccttaggttctgctctgtttctttgccaggtgaatgtttgtggcatgcgctgctgtccgcgcccctctgtcctgcgcagggttcagctgtgcggcgccctgatttcctccatgcacacagaacctccttgtgtctgtttctctgttcctctgtggctgactcaataaacttttccctctgacatgatgaaaaaaaagtg

SEQ ID NO: 65910 - DNA, 4660 bp, Homo sapiens
  misc_feature (1)..(1): n is a, c, g, or t
  misc_feature (556)..(556): n is a, c, g, or t
  misc_feature (4641)..(4641): n is a, c, g, or t
  misc_feature (4644)..(4644): n is a, c, g, or t
  misc_feature (4647)..(4647): n is a, c, g, or t
  misc_feature (4651)..(4651): n is a, c, g, or t
  misc_feature (4653)..(4653): n is a, c, g, or t
  misc_feature (4656)..(4656): n is a, c, g, or t
  misc_feature (4660)..(4660): n is a, c, g, or t
ncttcgacaatttttaaagtgctttaagtgactactttaaacaacctgcagactaaggaagttctcgtagctctggaaatggaaacagctggactagttcagtggggatgattcagcctgagtcacaggcccacacccaaatggaaagtgtaaaccctgaaggccttaggggatccctagagccaggaatcccctctgggacctaccacagtctctggactggctcaggtttcagtgattatttttagctcctctttatttatcctatggttctccatccttttcatcataatttatagtatcctttatttacatttccaataagtactggtgagtatgagtaattgcagaataaattaagatatgtccagtggacacttgacatgacacaaccctaaagaaaacatcaacctaccccgtatcttcacttagtctaaaagtctggaggagtccggatattcttggagtccccagaggcaacagcacttcatgtttaacttataggcaagcagacttaatgagatacagcatacaggatacacagcacatttccccncccactcaaaaatactttcataaaaacagtgaccagtgtttactctggccaggaactccaaaacataccctttgggcttgttcttcattaatatatcacaactgctctgtgagatggacatggttattatctccatgctcacacagctcataattggtggagccaaaaaatgaacacaagatctttgactccaaagcccaagttcttaccatttatgatgactaaaaaccagttgtatgttttttcctgaatatattcaacaaacttgtgttgagcaaaaactgtgttcaagcactgtgctagttacagagaattcaacaataaataaaactgacaaatgacataatggacttacatctcatgaggaaagtaaataatacaaatgagtagaataaattgtattgtgtaaatgtgataaagaaaaaactcaagaaaagcaagtggggtcattgagatgataacatttaaatcctatgattagtaatgatctttgcgagaaggtgataattaaaccaagaactgtaggaggtgaagaaacaagcccttctccatcctcaaccaacctagcctccagggaaaatagcattccaggccaaagggacaagtttaaaggctgtgaagcacctgggagcattgctagaatgacccaagaagagcaagaagacagatgggttgtagtgaattgacaagtaggagaggctaggaaaagatgagacctgagagagaataaggcaaagaagtggaggcttcttgtcagacgagaataaaagcaattgtctttcaaatagagttgagacataatctgatttatgtttttaaagggatactctggcttttgtattgaaaacagactgggaacataaggagagaagaacgatcaatctggtatacctgttaggaaactgttacaattcagaaaaaaaataatgtttgcttggaccaaagagagtattgaaactgatggaaaatgattgatgtacgtattttataggtggaactgatagaatttgctaatcaattgtatgtaaagtaaatagctgggtcaggcctgaacatttggaagaatggagatttattagctgagatgcagaaagcagtaggtgtagtaggtttaggtattttgctaagcatatatagtgaagaaagagagacaagagagtagagagagtatccagaaaaatgatcataaagattgaccatagactgtcactgggctgcagaagaatgatcaaggtggactgggaggggagtgtagaggtggtaggatcaagggctgtaggtctgtgtgaggctgcagggttgctggagtcagtactggaggggtgaggaatttaatcaacaccaactctagattcctgaagtcaaaaaacttattagaacatgtcctagcagagctcttaagagaggctagcttctgggactctcctatagtctatttcaatattagctttagataacttttttaaaaaaattattaatttaagggctgaatgattttctaattatctaaaaattaaagtcttcaccacttaatatttgaatactttataagataggatttgcctatttgggatatatttgagaattcccagaataaaatagattgtcccatgttagcagtcaaagcacatctttgggccatgagttaccgtattataaaaagatttcaaaatgaaataaaatgtattaatatagagattaaaggttaattattaatttgtgttattttcaaaaatagaacacacattcagaatttaaaattttcatattaatctaatgattggcaatcttttatgaaatcattttaccaacatcacttaattcttacaaagtagattatgataaaattatattttcctaaagtatatttttaaaataaacaaatgtgaatagttcatattcagaccatacaaatactttatatgtataattcagaccatacaaatactgtatatatataaccaatctcataggaagggggttggattcttatctccgtatgtttaatttgagataccagatagctcacctttccaaaatatgacctccccgagcactgaaatataaacgactaaatccatttctgttgtgtgtccaaagatccctagttcaaaacctacacattacttttgaggtttaagatacccccaatttattttctattgtcattatctattaataaagcagaaaagtcatggagaaattaagcattgatcaagtaagctttgttggagcatatgggaagaaaaagatctcaagaaaaagaaatgggctgggtgcagtggctcatgtttgtaatcctagcactttgggaggccgaggcaggtggattgctggattgcttgagcccaagagttgaagaccagcctaggcaatggggcaaaaccccatctctataaaaaacacaaaaatgagccaggtgtagtggtgcacacctgtagtctcagctatttgggaggctgaggtgtgacgatgacttgagcttgagaggcagaggttacagtgagccaagcctgtgccgttgcactccagcctgggaccctgtctcaaaaaaaaaaaaaaaaaaaaaaaggaatgacctaagggaggcagttcccaagtgagataatacaaggacaatgtggtgtcaatgagttgagatactcatttggaagaagaaaagaaagacaacatttctaccttttttttttttcctttttgagacaaggatctcactctgttgcacaggctggaaggctggagtgtggtggcatgattatagctcaacctcccgggctcaagcaatcctcccacctcagcctcttgagtagctgggactacagacacatgccaccttgcttggctgtttccctttttgtggagacagaggtctcactatattgcccaagctgctcttgaacacctgggctcaagcaatcctcctgcctcaccatcttaaagtgctgggattacaggcatgagccacggagcccgtcattgtttctactttaacagttaacctcatcaacattagtagcaattcttttgattaaaatacagcagatatattttttattaaatgattatgatcttggtttaaaaaaatttttttagaaaagcaaacaaattacataatacctttaatgataaaggtataaagagactttcagccatatgtatttctgtaacaatgtaagtgattatttttgtaatggaaagaatatatttttggaggggaaaggaacatacatgtttaattttatgaataatgaaggtggagtaaaggccaagaaaacttattattatgtataaaaatgttatttcaacattattattatctacaaaaccaaaatggatttaattaaggtgggcaaggaaggacatattttaaatgaaagaattttcttatgcctaaattggatactaaaaacattcaatactgtttatctgtattattttattaactttgaaaattattattatattgtcattcatttacatcctgatttaaagaaaagttttataactatttttggaaaagacctattagatccctgctaaggtcagttcttcaggataagacttattttattccttttgaataatcttgtatacttatgaggtcgaatgggtagtcaaggaaataaccatgttctcaagatgtggccactgtggtgaccatacagtaggctccagcgtttgcactgtagtccagctcattcaagcaaagctaactccagtagggaatttcccctgtagagagcatgtgcattttgattttacctgtcctctgactgaactatgctcattataacagtaaaaaacacaccctggatggagatttaaagtgctaatgagacatgtgatgtatgaataagcatgtacagcaactgcacatgtggactacccagaccatgcttactagtaacacttctttctacctccttatgaataattacgtaaaactcacataaagggagtctccctcgtgccagtctctcctgtctcatccttatgagcagcctaccctgaatactctctctcagtgtgtactgtatattctgcacctaactttcaaaatattattttcctttgcaataaattgntgntgntgcntnttntttn

SEQ ID NO: 65911 - DNA, 844 bp, Homo sapiens
aggactcagactgccccagagttatgcaatctaagagtatattaaccacttttaagtattatatgtttttctcttttttgagcttttgtcgatttgacacgttcatttcatttgaatgttggttctgaaaatgaagcatgtagttacttttccgttaacatacataacagcattttaaagtacctaaattccttttggaaggccgaggcggacggatcacctgaggtcagaagttccagaccagcctgaccaacatggtgaaacccgtttctactaaaaatacaaaacctagccccgggcgtggtggcacgcgcctgtaatcccagctactcaagagcctgatgcaggagaatcgcttgaaaccgggaggcggaggttgcagtgagctgagatcgcgccactgcactcagcctgggccaaagagtgagactccgtatcaaaaaataataataaagtacctggccgggcgcggtggctcacgcttgttatcccagcactttgggaggccgagacgggcagatcacgaggtcaggagatcgagaccatggtgaatggcgtgaacccgggaggcggagcttgcagtgagctaagatcgcgccactgcactccagcctgggcgacagagcgagactccgtctcaaaaataaataaataaagtacctacattcctaaaagcagtgcttaattctgcagcacatatactaaaattagaataatataaagattagcatggccccttcccaaggataacacgcaaattcgtgaagcgttccgtatttttaaatatatacacttactatgtaaccaaaaaaattaaaaataaacatataaattcctgaaagct

SEQ ID NO: 65912 - DNA, 440 bp, Homo sapiens
cagaaattaattagaacacttcatttaaaagaatttctttgatgcatcaacttctttcctctcagctccaaatctctgcactgctctgttctgtgatgctggagctgggccctgtaaacatttctcctttgcagctggcagaatgttaagctttgtctacagggctgggaggccactgcaggaggaaagtgcttctctcttctttgttcccatgtgattttccttctcttggggtacttggcagccagtgggtgcaggaatcccaaaagtgctcagctgcccagggagtctcacaggcaacccggaaggtggtttcttgcatcctgacgctgacttgcagaacctcggtgaacttctttaccatctaggaggtgatagctacatccgagtgaagtgactccagtgaagtcagtcttgaagagagggctcttccgaatttg

SEQ ID NO: 65913 - DNA, 155 bp, Homo sapiens
gtcattgaagctacatgtagaacgtgagagtattaaataactgaacagccttggcatgcctaggcagatatcccaaaacttgtattctctaccttctgctgacctatttggcaagacatttctgcccaacattaaagaaaatcttttattggaaa

SEQ ID NO: 65914 - DNA, 413 bp, Homo sapiens
aaaaaagacccaaatcaataagatcagagatgcagagatgaaaaagaagacattacaacaaataccacagaaattcaaaggattattagaggctgctgtgagcaactgtatgccaataaattggaaaacctagaagaaatggataaattcctaccaagattgaactatgaacaaatctaaaacctgaatagaccaataacaagtaatgagagcaaagctgtaataaaatgtctcccagcaaagaaagcccaggacatgattatttcactgttgaattttaccaaacatttacagaagaactaatactgattcattcacactattctgaaaaatagaggaggaggaaatacttccaaaaatgtattctacaaggctgatattacactgatactaaagctagatgaagacacatt

SEQ ID NO: 65915 - DNA, 267 bp, Homo sapiens
taaatgatggagttaaatgatgttgtcagtgcctatttaaaaaactactcttccccttctctatgagttctactttggtaaatattaatatttaaccagttagtaaaactaacaccactatttcaattctcttttgtgcatagtaagtaaattttgctttacttactttataaaaaaatactttacattttataaagcaggttttagaaaaacggtttacaagaaagtttgcctccatttcactgccaatttaatcacagggaaaat

SEQ ID NO: 65916 - DNA, 3040 bp, Homo sapiens
accagctttcccgtcccgggccagcgcaggcgctcaggcctcggaggcggggcgatggccacctcccaccgagtggcgaagctggtggcctccagtctccagaccccggtaaatcccatcactggagcgcgggtcgcccagtacgaacgcgaagaccccttaaaggccctggcggcagcggaggcgatcttggaggacgaagaggaggagaaagtggcgcagcccgctggggcatcgagatggggtttcaccatgttggccagattggtcttggattcctgacctcaagtgacccaaagtgctgggattacaggcatgaaccactgtgcctggccaattctgttgatttttcgagtgaaaactgcatactggattcagacactgctactaaaacgaactgctgctgcccagatgaataaccgttgctagactgacacaagccgacaggaagcagtcagagggctaacagaaaggagctgatttgaacaccagcttttctggggtggatgaacatgcaccgataagctatgaggactttgtgaactttcctgatattcaccactctaatgaggagtatttcaagaaagtagaagagttgaaggctgcccacatagaaactatggcaaaattagagaaaatgtaccaggataaattacatttaaaggaagttcagccagtggtcatcagagaagactctcttagtgactcttccagatctgtatcagaaaagaactcctatcaccctgtctcattaatgacatcattttcagagcctgatttaggccagtcttcctccttgtatgtgtcctcctctgaagaggagttacccaacctagaaaaagagtatcctaggaaaaacagaatgatgacctatgctaaggagctcatcaacaatatgtggacagacttttgtgttgaggattatattcgctgtaaagatactggcttccatgcagctgaaaaaagaaggaagaaacgaaaagaatgggtgcccacaattacagtaccggagccttttcaaatgatgataagagaacagaagaaaaaagaagagtccatgaaatctaaatcagatatcgaaatggtacataaagcgctcaaaaaacaagaagaggatccagagtataagaagaaattccgagccaatccagttcctgcatctgtctttctccccctttaccatgatttagtcaagcaaaaagaagaacggagaaggtctctgaaggagaaaagcaaagaagctcttttggcctcacaaaagccatttaaatttatagcaagggaggaacagaagcgagcagcccgggaaaagcagctgagagactttcttaagtataaaaagaaaacaaatcgatttaaagccagacccattcctcgatctacttatggttcaactaccaatgacaagttaaaagaagaagagctctatcgaaaccttaggacacagctgagagcccaggagcatttacagaactcatctcctctgccttgtaggtcagcttgcggatgcaggaaccccaggtgtcctgaacaggctgtaaagttgaagtgtaaacacaaggttaggtgcccaactcctgattttgaggaccttcctgagagataccagaaacacctctcagaacacaagtctccaaaactcttaacagtgtgtaaaccatttgatcttcatgcatctccacatgcatctattaaaagagaaaaaattttggcagacatcgaagcagatgaagaaaatttaaaagaaacacgttggccttatttgtctccaaggcgtaagtcaccagtaagatgtgcaggtgtaaaccctgtgccttgtaactgcaaccctcccgtgcccacggtatcttccagaggacgagaacaagccgtaagaaagagcgaaaaggaaaggatgagagaataccaacgagaactagaagaaagagaagaaaaattaaaaaagaggccactgctatttgaaagagttgctcagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaagctttaatgaagaagaaaaaatagaagaaagagagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacactatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaatcaaaatagcagcgggggggggccgaggccagtattggaggcgagggagatggtgaccggagaagctgctggccggacggccaggccacggaaaggggccggccaaaaaaaggtgaaaggtccgccta

SEQ ID NO: 65917 - DNA, 2746 bp, Homo sapiens
accagctttcccgtcccgggccagcgcaggcgctcaggcctcggaggcggggcgatggccacctcccaccgagtggcgaagctggtggcctccagtctccagaccccggtaaatcccatcactggagcgcgggtcgcccagtacgaacgcgaagaccccttaaaggccctggcggcagcggaggcgatcttggaggacgaagaggaggagaaagtggcgcagcccgctggggcatcggctgatttgaacaccagcttttctggggtggatgaacatgcaccgataagctatgaggactttgtgaactttcctgatattcaccactctaatgaggagtatttcaagaaagtagaagagttgaaggctgcccacatagaaactatggcaaaattagagaaaatgtaccaggataaattacatttaaaggaagttcagccagtggtcatcagagaagactctcttagtgactcttccagagcctgatttaggccagtcttcctccttgtatgtgtcctcctctgaagaggagttacccaacctagaaaaagagtatcctaggaaaaacagaatgatgacctatgctaaggagctcatcaacaatatgtggacagacttttgtgttgaggattatattcgctgtaaagatactggcttccatgcagctgaaaaaagaaggaagaaacgaaaagaatgggtgcccacaattacagtaccggagccttttcaaatgatgataagagaacagaagaaaaaagaagagtccatgaaatctaaatcagatatcgaaatggtacataaagcgctcaaaaaacaagaagaggatccagagtataagaagaaattccgagccaatccagttcctgcatctgtctttctccccctttaccatgatttagtcaagcaaaaagaagaacggagaaggtctctgaaggagaaaagcaaagaagctcttttggcctcacaaaagccatttaaatttatagcaagggaggaacagaagcgagcagcccgggaaaagcagctgagagactttcttaagtataaaaagaaaacaaatcgatttaaagccagacccattcctcgatctacttatggttcaactaccaatgacaagttaaaagaagaagagctctatcgaaaccttaggacacagctgagagcccaggagcatttacagaactcatctcctctgccttgtaggtcagcttgcggatgcaggaaccccaggtgtcctgaacaggctgtaaagttgaagtgtaaacacaaggttaggtgcccaactcctgattttgaggaccttcctgagagataccagaaacacctctcagaacacaagtctccaaaactcttaacagtgtgtaaaccatttgatcttcatgcatctccacatgcatctattaaaagagaaaaaattttggcagacatcgaagcagatgaagaaaatttaaaagaaacacgttggccttatttgtctccaaggcgtaagtcaccagtaagatgtgcaggtgtaaaccctgtgccttgtaactgcaaccctcccgtgcccacggtatcttccagaggacgagaacaagccgtaagaaagagcgaaaaggaaaggatgagagaataccaacgagaactagaagaaagagaagaaaaattaaaaaagaggccactgctatttgaaagagttgctcagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaagctttaatgaagaagaaaaaatagaagaaagagagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacactatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaatcaaaatagcagcgggggggggccgaggccagtattggaggcgagggagatggtgaccggagaagctgctggccggacggccaggccacggaaaggggccggccaaaaaaaggtgaaaggtccgccta

SEQ ID NO: 65918 - DNA, 2505 bp, Homo sapiens
gagaattgcttgaacctgggaggtggaggttgcagtgagccgatatcacaccactgcactccaacctgggcaacagagtgagactctgtctcagaaaaaaaaagaaaatatgtaactcttaatttttatatttggtcacatacaactgaaagtataacatagttattcttctcatttagatctgtatcagaaaagaactcctatcaccctgtctcattaatgacatcattttcagagcctgatttaggccagtcttcctccttgtatgtgtcctcctctgaagaggagttacccaacctagaaaaagagtatcctaggaaaaacagaatgatgacctatgctaaggagctcatcaacaatatgtggacagacttttgtgttgaggattatattcgctgtaaagatactggcttccatgcagctgaaaaaagaaggaagaaacgaaaagaatgggtgcccacaattacagtaccggagccttttcaaatgatgataagagaacagaagaaaaaagaagagtccatgaaatctaaatcagatatcgaaatggtacataaagcgctcaaaaaacaagaagaggatccagagtataagaagaaattccgagccaatccagttcctgcatctgtctttctccccctttaccatgatttagtcaagcaaaaagaagaacggagaaggtctctgaaggagaaaagcaaagaagctcttttggcctcacaaaagccatttaaatttatagcaagggaggaacagaagcgagcagcccgggaaaagcagctgagagactttcttaagtataaaaagaaaacaaatcgatttaaagccagacccattcctcgatctacttatggttcaactaccaatgacaagttaaaagaagaagagctctatcgaaaccttaggacacagctgagagcccaggagcatttacagaactcatctcctctgccttgtaggtcagcttgcggatgcaggaaccccaggtgtcctgaacaggctgtaaagttgaagtgtaaacacaaggttaggtgcccaactcctgattttgaggaccttcctgagagataccagaaacacctctcagaacacaagtctccaaaactcttaacagtgtgtaaaccatttgatcttcatgcatctccacatgcatctattaaaagagaaaaaattttggcagacatcgaagcagatgaagaaaatttaaaagaaacacgttggccttatttgtctccaaggcgtaagtcaccagtaagatgtgcaggtgtaaaccctgtgccttgtaactgcaaccctcccgtgcccacggtatcttccagaggacgagaacaagccgtaagaaagagcgaaaaggaaaggatgagagaataccaacgagaactagaagaaagagaagaaaaattaaaaaagaggccactgctatttgaaagagttgctcagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaagctttaatgaagaagaaaaaatagaagaaagagagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacactatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaatcaaaatagcagcgggggggggccgaggccagtattggaggcgagggagatggtgaccggagaagctgctggccggacggccaggccacggaaaggggccggccaaaaaaaggtgaaaggtccgccta

SEQ ID NO: 65919 - DNA, 1543 bp, Homo sapiens
attttcttggttttatacacttataaatgagacaagaggactttccattcatcttttcagggcagtttgaaagtccccttaaaatatttatgccttgaggatttcagaaattaaagtgtccagactattcctagagcataatatgtgtgatctcagaacctaggattttattctgcattccatgagaattaaccggtatagaagaggaatcgaggtaaactgtgaactgtgcttataatttctgatttgtcagctaagctaaatgttatttcttttttttcattgactttgtacaagttgataagttaaatgttacatatgtaagttcttatttcttagatgatcttttaaaattccattgcttttctttaattttagaaagagcgaaaaggaaaggatgagagaataccaacgagaactagaagaaagagaagaaaaattaaaaaagaggccactgctatttgaaagagttgctcagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaagctttaatgaagaagaaaaaatagaagaaagagagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacactatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaatcaaaatagcagcgggggggggccgaggccagtattggaggcgagggagatggtgaccggagaagctgctggccggacggccaggccacggaaaggggccggccaaaaaaaggtgaaaggtccgccta

SEQ ID NO: 65920 - DNA, 2975 bp, Homo sapiens
gggctgtggttgcctggtttacagcaggtagaaccgtgttcctcttcatctcagttaaaacttacaactcaggaggctccttatagaaatactttgtaaagggttgttgggttctatcctattataccttttgttggttgatctgggaattgaaccatcctttatcaaatggattaaataacatttattttctgacagtttggtcttgctccctctcgttcttaaaatatcactggggaaaatgtacatagcccacaaataacctataactcattctatatgcataagcccataattaatgtataacctaactaggtggactctttaagaagcagcattttgggatcagtgtcagcttaatttgtctttcagctccagtcactatatatcaagtgttttctccccaccaggctgatttgaacaccagcttttctggggtggatgaacatgcaccgataagctatgaggactttgtgaactttcctgatattcaccactctaatgaggagtatttcaagaaagtagaagagttgaaggctgcccacatagaaactatggcaaaattagagaaaatgtaccaggataaattacatttaaaggaagttcagccagtggtcatcagagaagactctcttagtgactcttccagatctgtatcagaaaagaactcctatcaccctgtctcattaatgacatcattttcagagcctgatttaggccagtcttcctccttgtatgtgtcctcctctgaagaggagttacccaacctagaaaaagagtatcctaggaaaaacagaatgatgacctatgctaaggagctcatcaacaatatgtggacagacttttgtgttgaggattatattcgctgtaaagatactggcttccatgcagctgaaaaaagaaggaagaaacgaaaagaatgggtgcccacaattacagtaccggagccttttcaaatgatgataagagaacagaagaaaaaagaagagtccatgaaatctaaatcagatatcgaaatggtacataaagcgctcaaaaaacaagaagaggatccagagtataagaagaaattccgagccaatccagttcctgcatctgtctttctccccctttaccatgatttagtcaagcaaaaagaagaacggagaaggtctctgaaggagaaaagcaaagaagctcttttggcctcacaaaagccatttaaatttatagcaagggaggaacagaagcgagcagcccgggaaaagcagctgagagactttcttaagtataaaaagaaaacaaatcgatttaaagccagacccattcctcgatctacttatggttcaactaccaatgacaagttaaaagaagaagagctctatcgaaaccttaggacacagctgagagcccaggagcatttacagaactcatctcctctgccttgtaggtcagcttgcggatgcaggaaccccaggtgtcctgaacaggctgtaaagttgaagtgtaaacacaaggttaggtgcccaactcctgattttgaggaccttcctgagagataccagaaacacctctcagaacacaagtctccaaaactcttaacagtgtgtaaaccatttgatcttcatgcatctccacatgcatctattaaaagagaaaaaattttggcagacatcgaagcagatgaagaaaatttaaaagaaacacgttggccttatttgtctccaaggcgtaagtcaccagtaagatgtgcaggtgtaaaccctgtgccttgtaactgcaaccctcccgtgcccacggtatcttccagaggacgagaacaagccgtaagaaagagcgaaaaggaaaggatgagagaataccaacgagaactagaagaaagagaagaaaaattaaaaaagaggccactgctatttgaaagagttgctcagaaaaatgcaagaatggcagcagaaaagcattattctaataccctaaaagcactaggaatatctgatgagtttgtttcaaagaaaggccaaagtggaaaagtacttgagtacttcaacaatcaagagacgaaaagtgtcactgaagacaaagaaagctttaatgaagaagaaaaaatagaagaaagagagaatggggaagaaaattattttattgataccaacagccaggattcttacaaggaaaaagatgaagccaatgaggaaagtgaagaagagaaatctgttgaagaatcacactgaatcatcaaggtctcctctctatgcccttgctgttgtttgcgtcagggtgtcagcagccgcatttgtgtttagaacatctgtggggacgcttctgatatgtgcagggctgttgatcaaagtcatctgtagcctgaaaagcctgaatccagctgattggtcatttgatcagttagagtaaggctttgcctattcagttttaaaaatcattgtgtattatctgtttgcaactatgattttgtatttttaaaaagtgagaaccacagctgtcacaaactgattagttataaaaatatacactatttcattaattttactggaaaaaatggcttagtattgaaaggagagagaagtattggtctttggtggtttactttttaaaaattttggaaagtgtgaatcaataactatttttaattatactatttgcccattctttttctctgcagtgcatttcacagaataaatcctctaacttgttttgctgctctgagccatttttaaaagtatagaaaaaacgccgggtatggtggctcatgcctgtaatcccagcattttgggaggccgagacgggtggatcacgaggtcaggagatcgagaccatcctggctaacacgatgaaaccccgtctctactaaaatcaaaatagcagcgggggggggccgaggccagtattggaggcgagggagatggtgaccggagaagctgctggccggacggccaggccacggaaaggggccggccaaaaaaaggtgaaaggtccgccta

SEQ ID NO: 65921 - DNA, 317 bp, Homo sapiens
acaaccatatataggactcagcacacagtaagccaggcatttgcgggacatggaggagatccccacgcttttgtttccctattaaagctctaccaatttttttagggaagctcaaacctcttcaccactgtctctctgcaatagctcactatttccacctattcggattatgtcttctctggtcacactaattcctttgagttaattattttgcttcagataccaactgcccaagatgagatgagtgaggccatcattggtcaggaaatggggtgaggtgtgtggtactactgaaaggtggcagatagatgcatcag

SEQ ID NO: 65922 - DNA, 4416 bp, Homo sapiens
  misc_feature (1)..(3): n is a, c, g, or t
  misc_feature (389)..(389): n is a, c, g, or t
  misc_feature (665)..(665): n is a, c, g, or t
  misc_feature (1859)..(1859): n is a, c, g, or t
  misc_feature (2174)..(2174): n is a, c, g, or t
  misc_feature (2244)..(2244): n is a, c, g, or t
  misc_feature (2890)..(2890): n is a, c, g, or t
  misc_feature (4380)..(4380): n is a, c, g, or t
  misc_feature (4413)..(4414): n is a, c, g, or t
  misc_feature (4416)..(4416): n is a, c, g, or t
nnncaatcccatgtatataattccttatgtgccaggttagatataataatataacttgagaatgtatatttcattttatttttgaaaatatacgtatcttaagattttcttcccaaggtttcatattataaatgaataacaatcatgactgcagaagaaatttaattataagcactgtccatctctccccattcccaaagtaaaataactgctttcagtttgaataggtaaattaaatgtttctctgctccttctattatagcttttaagaaacagtattaaatgattccttgagttgatttcactttaagattattttaatccattactcatttgagtttgcatcattgaattttctttatcaaggacgtaagcaggttaaatgtgtnttggggaaatgtcttaaatgtcagtactatggtctggctgccttgtgagtacctcatcattggaggtgttaataaggtgtgactggatggctagaaatattttaggtggatatcatacatcatgtagagctgaagactggaaaactgctaattctatgctgtgatccttacttatgtttattttccaatttagatgattaacagatacaaatagttatttccttcaaacattgcttgtttcacttcaaaactttgggaatgcatgctacggaaaantctacttcagtagcatgtgaaaaaatacatcttatttgccttaccatcagttttctaagcattttttttctcttttgaatactcataatattttatgtttgtcttataccatttatctcattctatctaataaatactaacttgtttatttctcttattgtccttattgggttttaaagttcttctggggagatatttaacaatctccgtataccccacatgagctatacagagccaacactatataaaataaagttatcaaatttcatttattgtcattagtgcctaaaacttggggaaaagttgctattgaataaaatagcgtacacttggtttctttcttatctgccagtcacagaatctactcttagcaaatgtcattctgatttagagtaattttctaatatagaaatctcatttacccaaataccattaaaattatctaataaggtaacgatttttaaaaggtcccatttcactatttccaaatggtatccaaaagtacttgtaaataaaaaatttaccctaagtgagctgtaggcatagcttccccatccaaaacataaagttatagaggctaatctcacgaacttttctgtggatttttaaggttaaactactggtaaagaagcaattggtaatttgttcagactggatgccagaatagctccgttgtctgttagctgatgtctttgaatctttgggctcactttttatcaatgtgagtttatgagaagccttaaactctggcatacttcaaagtctggtaactttttttaggcctctcacctcctttctgcaacctttcttaactctcacattagggggaaaaaacatatgggatctcaaaaaaactaagtaagcatattttattgtttatcttaaaaaatgcatttttttaaatcaaggaaaatcattaactacatcagtatcgatgaattacatgttgtagtcatcatattttaatgagtcttctctaatatttttagttctgagtttgtagaaagtggcagatgctgttctggttaaaaggctttccaactgattaacgtgttcatccctaatttaattttttaagaaagacacttatgacagcgagaagaaaacgtttcatcttcataggaaatctggcaaaatatcttggcttttgctcaaaatttgaaagcaaatgggaatcagtttcaaatattgganaagtcaagaaaacgattctagctctggctctgtcattggctctctatttcttcatgtataaaatgatggaaatagattaatttctaatacctctttcaactccactaacattcttttattgatagcatttgttagggagaaataacaagatttgtttatggattgtgataggatatcaataagggggtataacaaagatacctaaaattttcatccttggactagtaaagaatggtcagtccacaaaaacaaaataggggttttgtgttaagggtagccaggtcgaagataacttctgttttgaaatgttaaagnaatatcttctacaagtttatgagactcatgggagtggccattgcatggtaatatggcatagtattatatngtttacatacaatttaaaaagtacaggtagtactgaaaaacatctgttcctgtcctcatcccttttgactcctagatcagtttttccagggcaaaagttgcaaataatttttgctttatcaacattttttattaacttcatgctatgatagatgatgtactctttgtgctacttcccttatccctcttccaccatctcctcccaatgtgttactgtttttaattaaatcaataagcaatgtttacattattttgaatatgtacatattataaatatgttgcttattgtattgtcaggtaatactctatggttctatttctttttatcttttccctatagtttctaattacatttcttttattcctgtaatacatttcttatactatttgggtttttcttaatgctccatgatatccactttcctcactttttccctgagagactacactgggaaccaaattgtcagtggtctttttttattttctgattttgtttatggtacataaaaatagaattcactttaacatattggtttcatatccagcaactttgctaaaattcattaattctaatttctttgtagattcttttgaattttctctgtatgcaatcatatcacctgtgaataacatttttgtttcttttntttaaacaaactttttcttttctttcaataatggctaggccctaggttaaatccaactttatcacattttatttaatatttttgcatctgtattcattggtaagattggcctgtaatttttctttcagactcagttctgtttaggtttgatataatggttatgctaggtttatctctcctcttctgttttctggaagagtttggttaggtttaatgctttttgttctagcttaattacattatggttagagatcatgttctgtacaaattccatccttcgagatttgtttagacaagccttaaggtccagtatatggttagtttttataaatatcccggatgtgcctgatataaatgtgtgtctttcatttcatgaggcattgtattatatatgtccattagaacacgtttcttagtcatgttcaaatctttctacatttttacagtttattttctttacatgttcaatcagccattagaggtctgtttaaaatctccgactctgattgtggatttgtttatttcaatttgtttatttcaatttattttaatatcttccttgggaaccaaaccttttatcattctgaagtggccttgtttcagcttttgcaacacttgtgcctcaaaatctactttgactgaaattaatacagctatactagcttcttttggttattatttgtgtatgacttttaaaatttttaattccaacctttctgtgtaactgtatgtttttgatatctctgatgaatggctcaaatgttgaaatttgcccctgtttttgcagtctgaaggtatttgtctctagaatgtttctcaatgtacttacctaactttttagtaaccagattttcaaaaaatttaaagacgatataatgaacaccattgtatattcatctagattcaacacttgttagtattttgccatatttgtttgtctcttgctttccagggtatctatgtgtgtgcatgtgtttaatgattatgtaagtatatgtgtgtttatacacattttgctaagccatttaaaagtaagttgcagaaatcagacactttatatgcataaatacctgagcatgcatcatgcctcacctaaggaaacataaacatgacataattatcaaacataagaaaatcaacagcaatcttaaagtgttatttaatattcaagtcataaacaaatttccctaatggtcctaaaaagtctttcatagctgttcatgtactgcatttatttattctcttacaaatttgaatatctagaatgcgttggaggaaaattttccgtggatctttcatgtctctgtacatcctgagaagagaggcattgtcattgttctgaactctcttttcaaggatctgttataatgaataactcggaaaattgagatagtatctcactttggaggaaaggccaggtttgtctaccttctagtacaataaagatattaaaaatatctctgggcaaagataaagcaagcttactgccnactataaaatatatggattccctaaacacccanntn

SEQ ID NO: 65923 - DNA, 252 bp, Homo sapiens
tggaagaatggccaggaggagagggaaggggcctgtgatctccctggaagcttgtctgttctcaccaagtggctgttgaacaaaggctgttctccacattccttttcctctccatccaagtggtaaatatctctttgtttgtcttcacatttccttctgtgattctccttggctatggtattcttcattctgtcattctatcactctttcctgctcactcttctttattctctttgaaaataactgatttgg

SEQ ID NO: 65924 - DNA, 305 bp, Homo sapiens
atgttaaattaatcccaaaacaagaagatataggtaggagtacgtagctagctcactgcttctcctaggggcctgtctcagtcaatcccaatttccttataaaaacaaaaacaaaaacaaaaacaccagtgtacaaatcctcccctttctcttcaagtgtgcttgtcacttcccggacatgccctcttctgctcatctctctgagttatctctcctcccctgcctgggtctgaccccgggaaaatttaccctgcagatgtaaagctttgttttcataagcaaaaccactgactccacatggctag

SEQ ID NO: 65925 - DNA, 320 bp, Homo sapiens
gtggaatcgtcctcctcatactgtttatccattcattcagcagtggacacctgggttgcttctagcttttggctattgtgaataattcttctgtgaacgtggatttacaaaactctgctttcagttattttcgttgtatactcagaagtgagatcgctgtatcctaggataagactatttttgtaattttgagaaactgctgtactgtttttccatagtggctgcaccattttgcattctgggatgtgacgtggagcagaattaccttcagagtgaagttcaaaaactcactgggaataagtacagagaaatgatgctgc

SEQ ID NO: 65926 - DNA, 1016 bp, Homo sapiens
tccagccccattgcctccaaattccattgcatcttagaccagcaaacacaagtgaattctacttaaccccagaattctgtatgaaaatcttactgcctttttttttctaatcatgtgtcaaagtgtgggaagaacttttatttatgttttaataaattgtcagtataaccatttttacttgaaaatattataatttttcaagtaaacaaattgtttctctaagttgaaaattttatgatggaataaaagtatttttcctcaaaacacatagaaattttacaacaatattttagagttaactaaatgtttctttagtagtttagtcacttaaaaagtgatatgattatgaaaatacttaaactttgtcttttaactatttctaataatgctattgggtataatttcatatttttatactgatcttttctccaaactttaggtaaaacatacttctgtaaacccctgcccacaaaactgaagtccacatttacttctgaatgactgataagtttgtaaaagtatgcatgaatttcgttattaaattaaagtttttattatattttatgcacaatggtataaattattaaattaattttcaagcttatagaacattgataaagattgtcattagaaaaaccccctgagttgattgttatacattaccataaccctttcattggtggattagtgaatatgttatagggtgacccatgaatcccaaagaatcaaagctggctacagcaaacagagggtcaaaaggatatggaactatgcatgatccagcaaaacactcaatatctgttttccctggaatgttaaaagacaaagaagaaaacttggggaacactagatgcatatagttctggttctttaagaataaaaatatgggccgggcccggtgctcatgcctgtaatcccagcactttgtgggaggccaaggcgggtggatcacaaggttaggagttcaagaccagccaggccaacatagtgaaaccctgtctctactaaaaatacaa

SEQ ID NO: 65927 - DNA, 450 bp, Homo sapiens
gagccagttgcaaggagagactagggaagggcattgggtaactttgttgctaaaagctcttctggataaagacatttgggaaaagaagcaaatagagttcatcagaagaggtaagaaagtaagtttatgtttggccaggcacggtggctcacgcctgtgataccagcacttgggaaggccgaggcgggcagatcacgaagtcaagagatcggactatcctggccaacatggtgaagccacgtctgtactaaaaattcaaaaattaggtgggcatgatggcgcatgcctgtagtcccagttactcgggagcctgaagcaggagaatcacttgagcccaggaggtggaggttgcagtgagcggagatcatgccactgcaccccagcctgggcaatagagtaagactctgtcttaaaaaaaataaaaataaataaatggtatccccaatattt

SEQ ID NO: 65928 - DNA, 358 bp, Homo sapiens
gactctgtgaatctgtccattgctggtgggaatgtaaatgggcacaaatactctggcattacctagtaaagcttaagatgcccgtatcttagtacctagcagttccactcctcggtatggagcctagagagaaagtcttacgaagaatgctcatagcagcattgctcctggtggcctaagattggaaaccacccaaatgttcattggcagcgaagggataaataagttcctgtatagttacatatttacatagtaagtactgatatttacataatggaatgctacaaagcagtgaaatcaaagccactccaaatacgtgcacgaagaagaataaacccagaatatacagttgagcaaa

SEQ ID NO: 65929 - DNA, 173 bp, Homo sapiens
ttacagagttaagttcatgatctttggcattgcatactaggtctttcatacttgattcctgttcacttctttgtcttatcttgatcacttcctctattctctaagtttcattacatcacgtgactttaagtatttgtatatatttcttcctctgaaggcctgtggtgatcttt

SEQ ID NO: 65930 - DNA, 278 bp, Homo sapiens
gatgaacaagtattatattttgagttctttcctacactgtctcattttctataaacatactaatgcatgcttttaaattgttaataaattggagttttgctgcaaatttaaagaaaaagaaacatttcctcattttggtctttctttttttgcccttacacatgaaattctagatctctggaagggactcaacaaagctttcctaaattaattggctctgacggtaccttcttaaggatttctggtgtggctctgacatataagcaactcagataact

SEQ ID NO: 65931 - DNA, 369 bp, Homo sapiens
cggtaccctggcttgtggaagtcgggtaggctgtggaggagaggggcagggcagattcttgcaatggaggctctctcaggctcctggctgtgccttaggtgaggtcccccggctcagggcaggatgcatgccctaagctctctcctcatcctacctttccaggaactggcccatctcgggcagaagctggcagtggtgggcctggcttcaccttcaccttccgcagccccgaggaggtcttccgggaattctttgggagtggagacccttttgcagagctctttggtgagtggactctggaagcctctgaatggctcaacttccccctccaggcctgtccttccatcagctgggaggccctgaggtgga

SEQ ID NO: 65932 - DNA, 1950 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65933 - DNA, 3101 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctcccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggccttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactccctgcgggccgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaccgggggaccccagagggaggcctaggaggggactgcacccatactgcttccctaccacaaatcagggctcagggagaggccatgcggccagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65934 - DNA, 2296 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttgaaaaaaaaaaagaaaaaaaaaagggggggccggcacaaaaagtattcccttgcggggggcgcaatggtatataccgcgtcccccaggctttttcgttggtaccagaaggtgtggccccctattagtgtggacgccgtatttatgacgctaaaaggcactgggccgtcctgttttatccaacgctcgttgaacggggagaaaccttgcatcactttggggaccctgtggggagaggagaaccctctaaaatgacggggggcggaggccatagatcgggacaaacgtatcccctacggaagaattttaagcccctaagggaaacttataaatttaaaggtgttctacg

SEQ ID NO: 65935 - DNA, 1979 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttgaaaaactagagaaacaaagtaaaaatgaa

SEQ ID NO: 65936 - DNA, 1456 bp, Homo sapiens
gtgggttgaccgtggcttgtgggttgaccgtggcttgtgggttgaccgtggcttgtggacagaattaaccaatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65937 - DNA, 1223 bp, Homo sapiens
atcctcaaagatctttgagcttaccacacgcaggaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65938 - DNA, 1120 bp, Homo sapiens
ttatgggctatcgtcgatccaggcgctcgggagactgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65939 - DNA, 1583 bp, Homo sapiens
tggtacggtccggaagttcgtttggatacggttcccggcggggggcaggggcggggcgccgcaggaggccgggactcctggcggaggaggtgcggccgggggcccgggtcaggctgggggccctggatcggactgctggagttggggggccccgatagggctcctgggcctgggcgtcgagatagctcttggccccggcctgcgggggcagataaggctgccggagggagcctagtcaccggccgcaagcagagcccgctgtgctccgcttccaactgggagcgccttccgccacccggggagggggactgctgcagccacagggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaccgggggaccccagagggaggcctaggaggggactgcacccatactgcttccctaccacaaatcagggctcagggagaggccatgcggccagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65940 - DNA, 2231 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctcccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggccttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactccctgcgggccgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaccgggggaccccagagggaggcctaggaggggactgcacccatactgcttccctaccacaaatcagggctcagggagaggccatgcggccagcccaggtctgcatgtgagctcagatccagggggaaatgctggaagtcaataaaactgagttttgagagcttgcaaaaaaagaaaaaagtcgaccgccccgaaaaatattattgtgctagtagtagta

SEQ ID NO: 65941 - DNA, 725 bp, Homo sapiens
atctcacagcgagtgacaagccgacctggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65942 - DNA, 1205 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65943 - DNA, 891 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgagaaaactgaggcacagttaatagcccagagtcacataacacatggcagagctggactcctagctgtgtctgcctgtcatcgcgtcatgatgatttgcctgtactgaaagagccatctgtcctccatccctcttccccctccttccttcctttattctttattgtggacagaattaaccagtgagtgttttcgaattcaacattaaaaaggaatttataaataagcccaactaaaaagcggaaaagaaaaaccctacccagttgcttagtggtttatacttccagacttgggctcacccatatacggaatcctctagagtcac

SEQ ID NO: 65944 - DNA, 837 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacagtaagggccggggtcaggcaggacccagcacatcaccccctacttcatgccccagctcacattttcttaaagcaatgtctctgccacctagtttcctctgtgcctttttccagcctgacatttaagctcccccctcccacagggacagctcagtgtctgctccccagagtctggtaggagtggctggcatgagacctgaaaggggaaggaagcagggcaggtaactcatgtgagctgagcctcctgcgtgccaggcattggtgggtgtcatctccatgagttctcacagccgtcctatgaggcaggttctatcacccctattttacaggcaaggaaactgaggctgagagaggtgaagtaacttgctcaaggccacgcagagctggaatacgaatccaggtctgcctttttattgattcattcgaaaagtaattcagtgaatggtgaca

SEQ ID NO: 65945 - DNA, 164 bp, Homo sapiens
atgacctgggccccttctcagagcttcagaaccggggttcccgacactcaggccccttctttaccttctcttcctccttccctgggcactccggtaagttctgccccttcccacgtttgcaagctccgattcctggaacccctggcttgagcttgttgcttttc

SEQ ID NO: 65946 - DNA, 3028 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctcccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggccttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactccctgcgggccgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaccgggggaccccagagggaggcctaggaggggactgcacccatactgcttccctaccacaaatcagggctcagggagaggccatgcggccagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatcccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65947 - DNA, 3073 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctcccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggccttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactccctgcgggccgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaggggactgcacccatactgcttccctaccacaaatcagggctcagggagaggccatgcggccagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65948 - DNA, 3011 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctcccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggccttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactccctgcgggccgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaggggactgcacccatactgcttccctaccacaaatcagggctcagggagaggccatgcggccagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65949 - DNA, 1939 bp, Homo sapiens
tggtacggtccggaagttcgtttggatacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtaagtgcctccgtatgcaacagaagacctctcaccctccacccgccaccaccatggggcacttcagagtgacacctgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65950 - DNA, 1896 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacagaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65951 - DNA, 3284 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcaggtgagagctccttctggggccatagaggggtgagaggtctgctggggagctgtgttcaaatagaaagttggctccttgagggcagggcccagtctgcgctctctactgcggtggccagaactgggaccagcgcctgcaggattctgtcactgctcgttgcctgaactgtgctgtctcccacagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctcccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggccttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactccctgcgggccgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaccgggggaccccagagggaggcctaggaggggactgcacccatactgcttccctaccacaaatcagggctcagggagaggccatgcggccagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65952 - DNA, 2453 bp, Homo sapiens
aaggatctcaggtgctcatcccacctggcttacaggactatagcctgggtggacatgaatccacgtcacactgggtgtgcggggctggaggaaacttgtgagggagcttggagttgaaagcagttctacaactcaggatactccctcttctcttccacagtgagtcatgaccccccagtcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcaggtgggcgggaggcacagcaccgacggcaggggcggcccaaggcccagcaccaagatccaggcttgggggggacccaggagggtgcgaggggtgaagcaaccaaacgcagtccatccccagaggagaaggcctctcgctgcctcatcctctgaacaccgggcccaacctgatctgatccagatcttgactggggggtctgactcactgtgggaagagaagaggggagtatcctgagttgtaggaactgctttccaactccaagctccctccacaagtttccctcccaggccccccacaccccagtgtggacttgggatttgctgtgctcagcccagggctgataggtccctggtgaagcccagggtggggggtgtcagggcagtggaggggcccgaggagccaggttgcatttattggatggggagctccaaggggcattagtggtttgggctgggccttttgtgccctggtactctgccacctgtgttgctgatggtgtcaaggaaggaggacttggcctagggttgtctgagccggagccggcagctccactggagagcagtgcaggcagagtggagcctcctgctctcctggaccagctgcagacccccaaccctggtttctgtgccatgttgcgctctgaccgtctctgttgcttctcttctggtgttgcttctcctccctcccattctctctgcaactccctgcgggccgcatcgcttgctttcactgccgtctggctaggactcccttcttccttccttccccgagaaggcctcaatgtggcgaggaagatgctggggccggtagggctgtgagatcttctggggaggctagccgggtggggcgggagcctctcagctgtccagattcagaactggagcccactcctcctccctctcgttgcctcagcctgccctcaccctcaggactaggcagaggtgaggctggctcaccctgaagaggtgggataggaccgggggaccccagagggaggcctaggaggggactgcacccatactgcttccctaccacaaatcagggctcagggagaggccatgcggccagcccaggtctgcatgctgagccccatcctccacagcttgccgctgacgctctctcctgtcaccccgcccctgctctctccccagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatccctgtagggctggcagggttgtagatgaagggggaatgatctgagccttggttcccctgacacgtcttgctagccccagggttagagtgggcagggcagagccgcgcagcacctgggagcggtacctttcccttgggcagcctggggtcccaggaacaagccagggcgagtggcatgtctgcctgagcagggtgtggccccagaaagctgaggagtgtgggctggcagagagcttcgagggcaaggccacccgcgggggcgtgtgtgtggtggggcttggcatgtgatggcagctccaggcatgccgctgcttgtatggctttctttggcctctgaccctgctgcccattctttccaacatcacagatgaactgcctctcctcctccctgcctggggagcccagtggccagggaggggagtggtggagccagtcgctgtaacactgagcctcagagacgaaccaaaaccagctgggctgagctcagatccagggggaaatgctggaagtcaataaaactgagttttgagagcttg

SEQ ID NO: 65953 - DNA, 1463 bp, Homo sapiens
ggagccggccttctccccgtctctagtagtttccgcaccgctgacgcatgcctgcgcgcacagctgggccgggcgcgtcctacgcagcagccgcgagccgggctgcgggtgccagacggttcccggcggggggcaggggcggggcgccgcaggaggccgggactcctggcggaggagccccaaggaggcccgcctgacgactgaccagttgccatggcatcctactacgagatcctagacgtgccgcgaagtgcgtccgctgatgacatcaagaaggcgtatcggcgcaaggctctccagtggcacccagacaaaaacccagataataaagagtttgctgagaagaaatttaaggaggtggccgaggcatatgaagtgctgtctgacaagcacaagcgggagatttacgaccgctatggccgggaagggctgacagggacaggaactggcccatctcgggcagaagctggcagtggtgggcctggcttcaccttcaccttccgcagccccgaggaggtcttccgggaattctttgggagtggagacccttttgcagagctctttgatgacctgggccccttctcagagcttcagaaccggggttcccgacactcaggccccttctttaccttctcttcctccttccctgggcactccgatttctcctcctcatctttctccttcagtcctggggctggtgcttttcgctctgtttctacatctaccacctttgtccaaggacgccgcatcaccacacgcagaatcatggagaacgggcaggagcgggtggaagtggaggaggatgggcagctgaagtcagtcacaatcaatggtgtcccagatgacctggcactgggcttggagctgagccgtcgcgagcagcagccgtcagtcacttccaggtctgggggcactcaggtccagcagacccctgcctcatgccccttggacagcgacctctctgaggatgaggacctgcagctggccatggcctacagcctgtcagagatggaggcagctgggaagaaacccgcagatgtgttctgagctggatgccgggttccagaatcgctgcacagttccaacaggacagcgccttcccccatgcgctgggaggggaccctccatttctccccctcacccatgctgagtgtagagccggggcctgggtggcgggtgggggccgggtgggaggtggcagtagtcttagcctgtgcactctcttccttgggtgtttggtgctggctcctggggactacaaatcccagagtgcggtgtgcccggcctcatttctgatagatcccgcttgggggaggtggtgtatggttacggagctgtgcatcttgggacatgtagtagcccaggtcggcttgtcactcgctgtgagatggggagattttgtcttttgatttatcctggagatgtagggtcttggtgagcagcacaaccaggagggccgacct

SEQ ID NO: 65954 - DNA, 1086 bp, Homo sapiens
  misc_feature (926)..(926): n is a, c, g, or t
aggccagacagcctgtgacagagaaactaggcggtccgctcctgggacgcggtctcgggggcgggttcgcccctgaggcccggtgacccttcgcccgcaaccagggctagcgcttgtgtgcgcccacggaagcacccgagcgaccggagaaagaaaaagtggtcaaggggacctccttccagctctacgcgcctctcattcagagagaatctgttaaatcaaaatatcaagacctactggcagttgaacatcaaggggtgaaactgcttgaaaacagacatcaacagcaaagtacctttaaaccagaagaaattctttacaagactttgggtttcagtgttgcccaagcaactagctcattgatttctgctggaaaaggtgtcttcgttactaaaggattggtaccaaaaggcgcagtcgtatctatgtatcctggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttaaaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttngttaatcacttctctgagttctacctgtaaaacaaatattttgagacttaatgggaactacggaatttcttatgtctagtcgactattatatttatggttccaatttcatgattaaagctactgcctccattacaatttcaaatctggtatgccaattcc

SEQ ID NO: 65955 - DNA, 440 bp, Homo sapiens
gtcgcctgttcttccctgttgcgttcggcactgactggggagcttgtatctgggcaaaaatggaaactttttaaaaagactgcccttaccgcgtgagagtgcgtggctttttctccaccaggggttaattaggtgcttgaacttcctcagaaaagccaagccagggtttattttcatagttcatacaagtacttcacgtggttaaagaagcccatcccggctgtgagaatagcgtgcagtagctcgcgcgttaagaacgggcagaacgccactcaaaagcacgtcgggatggtgggtttcggattggggaccctccgatatgttccagaggaatccaaagacaaagttatctcagatgaagatgtcctaggaacattactgaaagttttccaggctctattcttaaatgatttcaataaacaatcagaaatcttgaaaat

SEQ ID NO: 65956 - DNA, 959 bp, Homo sapiens
  misc_feature (799)..(799): n is a, c, g, or t
gtcgcctgttcttccctgttgcgttcggcactgactggggagcttgtatctgggcaaaaatggaaactttttaaaaagactgcccttaccgcgtgagagtgcgtggctttttctccaccaggggttaattaggtgcttgaacttcctcagaaaagccaagccagggtttattttcatagttcatacaagtacttcacgtggttaaagaagcccatcccggctgtgagaatagcgtgcagtagctcgcgcgttaagaacgggcagaacgccactcaaaagcacgtcgggatggtgggtttcggattggggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttaaaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttngttaatcacttctctgagttctacctgtaaaacaaatattttgagacttaatgggaactacggaatttcttatgtctagtcgactattatatttatggttccaatttcatgattaaagctactgcctccattacaatttcaaatctggtatgccaattcc

SEQ ID NO: 65957 - DNA, 773 bp, Homo sapiens
  misc_feature (613)..(613): n is a, c, g, or t
tggtcacggccccgcggggcagccatgcctggccgtctgctgcggggcctgtggcagcgatggcgccgttacaagtaccgcttcgttccctggatcgcactgaacctaagccacaacccgaggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttaaaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttngttaatcacttctctgagttctacctgtaaaacaaatattttgagacttaatgggaactacggaatttcttatgtctagtcgactattatatttatggttccaatttcatgattaaagctactgcctccattacaatttcaaatctggtatgccaattcc

SEQ ID NO: 65958 - DNA, 1029 bp, Homo sapiens
  misc_feature (869)..(869): n is a, c, g, or t
gtcgcctgttcttccctgttgcgttcggcactgactggggagcttgtatctgggcaaaaatggaaactttttaaaaagactgcccttaccgcgtgagagtgcgtggctttttctccaccaggggttaattaggtgcttgaacttcctcagaaaagccaagccagggtttattttcatagttcatacaagtacttcacgtggttaaagaagcccatcccggctgtgagaatagcgtgcagtagctcgcgcgttaagaacgggcagaacgccactcaaaagcacgtcgggatggtgggtttcggattgggtttccagccctccacacacatgagaataagcttatagttccttaaggccaggaacccagaagttatgcaggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttaaaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttngttaatcacttctctgagttctacctgtaaaacaaatattttgagacttaatgggaactacggaatttcttatgtctagtcgactattatatttatggttccaatttcatgattaaagctactgcctccattacaatttcaaatctggtatgccaattcc

SEQ ID NO: 65959 - DNA, 559 bp, Homo sapiens
tgcaatgggagggatcgactcggccctttaaaaatgagtgatagtacatggctaacgtcagaaattcataaccctctggctgtgggacagtatgtcaacaattgttccaatggtaagaaggcatcatggggctgtgagatgagatatatcaatggctaattctactcctttgtcatatgactgagtgccaagggcagttgagtataacatataataagctagtcaagtccttaagcaactctcacttttgggggatgatattagagagaattaggggaaatcttgatatacattatttagaattgtttaatttactatttttcttctgattttgcagtgaatataggcaattgataactcccctttgatcattattattttagcattttaaaaatagaaattattatgtcagtgcttcaatatagccttatagattaatggctagactagtatctgctttctgttgctaagtttgtgagtccctatctatatcttctttaggagttgactttcccataggtaaaagtttgattgtttgaatacatttaacatgggcttt

SEQ ID NO: 65960 - DNA, 279 bp, Homo sapiens
atgagaagtacagtttataatattctagttaacactataccaaagattttgaatagttcagggaaataatacagtttagaaatttgaggatttttattttctaccactgaaataattaaacatattttaaaatactacagtagagtttattattttatacaaagtgaggcacaacattgttttccaaatgcaaaaaaaaaaaaactgtagtgtggatgttaacaggcattaccatgaaatgtgacattaaaacacaattttcacaaaaacatgtaggtt

SEQ ID NO: 65961 - DNA, 555 bp, Homo sapiens
ttattctacttaggattttcatgtatcttattatatctggtatctgaggcctataattggcttcaaacttgcattgacccactgtcaagccaataaggctttgccctacataacacatttttatgaagggatctgacacatctccatgaacatagtaatgaaggttatgcccataatgatgaggcctgttactctgagatttatgttgcaggcttgtcctgtagtgtactttctgtggtgcacctttcttaccggaactcacaggcaaaaggagacttaataagtgacataaattacataatattttgggtatacttttacattttcattagtacaactcaattcccttgctctctggccctccgacacttttctttattctgtggttttacattcttaagtttgaaattttcactttaggcaaaatgtaaagtttatgcaagaggttttcagaattctagaatttcagaattctgtttttaggtgctttcatttacattgtcccaaatgtaattggctccattaaaattaagtgttctgatggcttctgaaaat

SEQ ID NO: 65962 - DNA, 1414 bp, Homo sapiens
attcagagcaggaggctgccggaggttctaagagaatattgggcaagaagcacatgcagtgaaattaaaagttgaaaaagaccaaaatcagacttcaaatgggggtaaaagacattaaagtaaatatatcagaaaagaaatacagtaaattgggaattaatatttatttataaaaatactaaaatgtgttcacagatctaaaggggcattttgaagtatttttaaaaggggtttggaggtagcatccgaaatcatataaagattggggataaatgttgaatttttgagatatggaatgtctattaagaggtggaataaagattgtatgtgtcatactctttggaggaaagtggtcccccaaaatgacagcaattcctaaggagtttgtgaaggggtacatgttggaatcatatagagtaaatatcataaaaactatccatacattactgttgcattggcaagagcacatcatttagaatatacatccaattattaaatttatttaataggcaagatgttatagagaagacagttctcaagattctttttcagtttccattgactaaatttctaactttagaaagctctgaatgtgacatatttcgccattcttcagcaagagtgatgtcaaacttacatccccactttgcaaaaatatatcacttcaatggaggtggcatataaacctgaatttttattttatggaaggttgctatgtgaatatacagagctgaaggtttaggagggcaactaagggtcttatcgtaccacatctctggcccttattgaatgtttcttttcctaagtccattcctgactccagttttgctgtataatcctgagactcctttacagaatacggggatctaacatgtagagactattcctgtaattggtgtttcttggaggcattgcaaaaccaaatttttctttactttgtagcacttttgactaatgttatctaaggactgtatcaaagaattggtttctattagattttagtttaagaaatcttacaattttgttacagagcaggctatttggaggatgaaactgaaattaatttttcctcataaggcacaagaaatgaaatttgcaatgcactcgtactgtattttcatcttttttctcttgaatttgcatttgtaaactttgattcacatgtagtatttgtcaactctgatttatatgacaaaagatacatattttaaaaatatatattttaaaaaggaaagattttttctttttttagtgatctacaaacctttaaatttagataattttaatttattattttaagatataagtcatattaaaacttaggagctctaaaactttttccaattttcaaggtgattatatcaccatgaaaaaaatttaaaagttaattattacttccatcaaaattatgtca

SEQ ID NO: 65963 - DNA, 441 bp, Homo sapiens
gagttgagtttaccatcccactgagggagaactgggcgctgccattctttgcaattcagatagcagcaattacatatttcctgagaccaaacttacagcctctttctgaaaggctgacacttcttgccattttcatatcaacttttctctttagtctgacatggcaatttaatcaatttatgatgctgatgcaagcattagtgctgttcacactggactccctggacatgctgccagcagtgaaggcgacatggctgtatggaatacagataacaagtttactcctggtctgcattcttcagttttttaattccatgattcttggatcactgcttatcagttttaacctttcagtattcattgcaagaaaacttcagaaaaatctgaaaactggaagcttccttaataggcttgggaaacttttgttacatttatttatgg

SEQ ID NO: 65964 - DNA, 238 bp, Homo sapiens
  misc_feature (22)..(23): n is a, c, g, or t
  misc_feature (25)..(25): n is a, c, g, or t
ccgcctactactactatacggnngngagaagacgacagaagggtcattcggggcgggagaccctgagcctgctgagaaatccttttagcgccagcaagccccacccagggccctgtcctgtgtctgccaccacctttgtctgatacttgtttccagggaagctgggggaactgccacatctgaggaactggaataaagatgagggggcttcgggggcccccagactgtgtgcccaaaa

SEQ ID NO: 65965 - DNA, 794 bp, Homo sapiens
gtggacacacaagagttaactggcgggtgtgacaggcggaccgccctcaggaagtgttactcactggggatgtgcgtgccttgccttgggactggattctcttcctgaagcgaaggagctcccagccatggaaagccctggagagtcaggcgcgggctctcctggagcccccagcccgtccagcttcactactgggcacctggcgagagaaaagccagcccaggacccactgtatgacgtgcccaatgccagcggcgggcaggcaggcgggccgcagcggccggggcgcgttgtgagcctgcgggagcgcctgctgctcacccggcccgtgtggctgcagctgcaagccaacgcagcggccgcactgcacatgctgaggaccgagcccccggggacgttcctcgtgcggaaatctaacacccgccagtgccaggccctgtgcatgcggttgcctgaagccagtggcccctccttcgtctccagccactacatcctggagagccctggcggcgtctccttggagggctcggagctcatgttcccagacctagtccagctcatctgtgcctactgccacacccgggacatccttctcctcccgctgcagctccccagagccatccaccacgcagccactcacaaagagctggaggccatctcccatctgggcattggtaagggcttcctgccacccattgcacagatgaacaagctgaggccgaggggaaggcaaggctcgcagcacaccgcccgaagcccctgccttgccttggttgggaaacttcccctaacca

SEQ ID NO: 65966 - DNA, 2693 bp, Homo sapiens
gtggacacacaagagttaactggcgggtgtgacaggcggaccgccctcaggaagtgttactcactggggatgtgcgtgccttgccttgggactggattctcttcctgaagcgaaggagctcccagccatggaaagccctggagagtcaggcgcgggctctcctggagcccccagcccgtccagcttcactactgggcacctggcgagagaaaagccagcccaggacccactgtatgacgtgcccaatgccagcggcgggcaggcaggcgggccgcagcggccggggcgcgttgtgagcctgcgggagcgcctgctgctcacccggcccgtgtggctgcagctgcaagccaacgcagcggccgcactgcacatgctgaggaccgagcccccggggacgttcctcgtgcggaaatctaacacccgccagtgccaggccctgtgcatgcggttgcctgaagccagtggcccctccttcgtctccagccactacatcctggagagccctggcggcgtctccttggagggctcggagctcatgttcccagacctagtccagctcatctgtgcctactgccacacccgggacatccttctcctcccgctgcagctccccagagccatccaccacgcagccactcacaaagagctggaggccatctcccatctgggcattgagttctggagctcctccctcaacatcaaggctcagcggggcccggctggaggcccagtgttgccccagctgaaggcccggtcccctcaagagctggaccagggcaccggagccgccttgtgcttcttcaaccccctgttcccgggggacctagggcccaccaagcgggagaaattcaagagaagcttcaaagtgcgcgtgtccacagagacctccagccccctgtctccacctgccgtgccacctccccccgtccccgtgctgccaggggcagtccccagccagacagagcggctgcccccttgccagctgctacggagggagagctcagtggggtaccgcgtgccagcaggcagtggccctagccttccgcctatgccctccctccaagaggtggactgcggctcccccagcagctccgaggaggagggggtgccagggtcccgggggagcccagcgacctcaccccacctgggccgccgacgacctctgcttcggtccatgagcgccgccttctgctccctactggcaccggagcggcaggtgggccgggctgcggcagcactgatgcaggaccgacacacagccgcgggccagctggtgcaggacctactgacccaggtgcgggctgggcccgagccccaggagctgcagggcatccgtcaggcgctgagccgggcccgggccatgctgagtgcggagctgggccctgagaagctgctgtcgcctaagaggctggaacatgtcctggagaagtcattgcattgctctgtgctcaagcctctccggcccatcctggcagcccgcctgcggcgccggcttgccgcagacggctccctgggccgcctagctgagggcctccgcctggcccgggcccagggccccggagccttcgggtcccacctgagcctgccctccccagtagagttggagcaagtgcgccagaagctgctgcagctgctccgcacctactcacccagcgcccaggtcaagcggctcctgcaggcctgcaagctgctctacatggccctgaggacccaggaaggggagggcgcgggtgccgacgagttcctgcctctgctgagcctcgtcttggcccactgtgaccttcctgagctgctgctggaggccgagtacatgtcggagctgctggagcccagcctgcttactggagagggtggctactacctgaccagcctctctgccagcctggccctgctgagtggcctgggtcaggcccacaccctcccactgagccccgtgcaggagctacggcgctccctcagcctctgggagcagcgccgcctgcctgccacccactgcttccagcacctcctccgagtagcctatcaggatcccagcagtggctgcacctccaagaccctggccgtgcccccagaggcctcgattgccaccctgaaccagctctgtgccaccaagttccgagtgacccagcccaacacttttggcctcttcctgtacaaggagcagggctaccaccgcctgccccctggggccctggcccacaggctgcccaccactggctacctcgtctaccgccgggcagagtggcctgagacccagggggctgtgacagaggaggagggcagtgggcagtcagaggcaagaagcagaggggaggagcaagggtgccagggagatggggatgctggggtcaaagccagccccagggacattcgggaacagtctgagacaactgctgaagggggccagggtcaagcccaggaaggccctgctcagccaggggaaccagaggcagagggaagccgggcagcagaggagtagcttgaagtggccagaagggtcattcggggcgggagaccctgagcctgctgagaaatccttttagcgccagcaagccccacccagggccctgtcctgtgtctgccaccacctttgtctgatacttgtttccagggaagctgggggaactgccacatctgaggaactggaataaagatgagggggcttcgggggcccccagactgtgtgcccaaaa

SEQ ID NO: 65967 - DNA, 2236 bp, Homo sapiens
gtggacacacaagagttaactggcgggtgtgacaggcggaccgccctcaggaagtgttactcactggggatgtgcgtgccttgccttgggactggattctcttcctgaagcgaaggagctcccagccatggaaagccctggagagtcaggcgcgggctctcctggagcccccagcccgtccagcttcactactgggcacctggcgagagaaaagccagcccaggacccactgtatgacgtgcccaatgccagcggcgggcaggcaggcgggccgcagcggccggggcgcgttgtgagcctgcgggagcgcctgctgctcacccggcccgtgtggctgcagctgcaagccaacgcagcggccgcactgcacatgctgaggaccgagcccccggggacgttcctcgtgcggaaatctaacacccgccagtgccaggccctgtgcatgcggttgcctgaagccagtggcccctccttcgtctccagccactacatcctggagagccctggcggcgtctccttggagggctcggagctcatgttcccagacctagtccagctcatctgtgcctactgccacacccgggacatccttctcctcccgctgcagctccccagagccatccaccacgcagccactcacaaagagctggaggccatctcccatctgggcattgagttctggagctcctccctcaacatcaaggctcagcggggcccggctggaggcccagtgttgccccagctgaaggcccggtcccctcaagagctggaccagggcaccggagccgccttgtgcttcttcaaccccctgttcccgggggacctagggcccaccaagcgggagaaattcaagagaagcttcaaagtgcgcgtgtccacagagacctccagccccctgtctccacctgccgtgccacctccccccgtccccgtgctgccaggggcagtccccagccagacagagcggctgcccccttgccagctgctacggagggagagctcagtggggtaccgcgtgccagcaggcagtggccctagccttccgcctatgccctccctccaagaggtggactgcggctcccccagcagctccgaggaggagggggtgccagggtcccgggggagcccagcgacctcaccccacctgggccgccgacgacctctgcttcggtccatgagcgccgccttctgctccctactggcaccggagcggcaggtgggccgggctgcggcagcactgatgcaggaccgacacacagccgcgggccagctggtgcaggacctactgacccaggtgcgggctgggcccgagccccaggagctgcagggcatccgtcaggcgctgagccgggcccgggccatgctgagtgcggagctgggccctgagaagctgctgtcgcctaagaggctggaacatgtcctggagaagtcattgcattgctctgtgctcaagcctctccggcccatcctggcagcccgcctgcggcgccggcttgccgcagacggctccctgggccgcctagctgagggcctccgcctggcccgggcccagggccccggagccttcgggtcccacctgagcctgccctccccagtagagttggagcaagtgcgccagaagctgctgcagctgctccgcacctactcacccagcgcccaggtcaagcggctcctgcaggcctgcaagctgctctacatggccctgaggacccaggaaggggagggcgcgggtgccgacgagttcctgcctctgctgagcctcgtcttggcccactgtgaccttcctgagctgctgctggaggccgagtacatgtcggagctgctggagcccagcctgcttactggagagggtggctactacctgaccagcctctctgccagcctggccctgctgagtggcctgggtcaggcccacaccctcccactgagccccgtgcaggagctacggcgctccctcagcctctgggagcagcgccgcctgcctgccacccactgcttccaggtaacaggccctccaccgtgtcctcagagccagacgccatccccgcctttcaccttcctgtccttggtgaagagtccagactctgtagacagatcctgggttctaatcctggctctgccactgggttgtggggacttgggcgagttacttaactacttcgtgcctcagttttctcatcagtaaaatggggtaataggacctacctcctggggttgaggtgaagattaaatgagt

SEQ ID NO: 65968 - DNA, 747 bp, Homo sapiens
gttttgtccctctgaacctagttttcttatctataaaatgggaataacaacatgtcatatagtcattgggagggttaaatctgataatccatgcagagtacatacatgggttagttactgtcattattagttattatcattattcatttcactctctgccaaaacctggcacagtcccaaacagctggaagccttttattcctaaagagactcttctgtttctcaccagcacccccttcagcttggtttgattcaataaactctcattgagcttctggtctacgtcaggctctgtgcaggaccttggtgatggggactacaccaccatcgtccccgccctcaaagagctcaaagtctagtgatgagcagaccccctttctcccaaaagtaacagagaggcaaagtgatagggctatgcaacagaaatgtggaagtgcagccacaggcctttaaatgtatgtagtgctgatattctgaataagttatatatgcacacagtacacacttcacagggcacaaaagggtatggaatgaaaaggaattctccctcccaccctgtctctcagctcataaattcctcttcctgggtcaaatacagttgccagtttcttgtgtgtccttctggatatattctctgcctatatattcctttaaaacacacacattgtatagacgttatacacacagttttgtctcttacttttttcacttatagaatatatgttgatgtttttatgtcagtctcta

SEQ ID NO: 65969 - DNA, 1905 bp, Homo sapiens
  misc_feature (181)..(181): n is a, c, g, or t
  misc_feature (184)..(184): n is a, c, g, or t
  misc_feature (665)..(665): n is a, c, g, or t
  misc_feature (1905)..(1905): n is a, c, g, or t
tgaccgagtctcactctgtctcccaagctggagtgcagtggcgcgatctcggctcactgtaacctccgtctcctgggttcaagtgattctcctgtctcgccttcctgagtaactggtactataggtgcatgccagcacacccggctgattttttattttattttattttttattttttttngtngagatgggtttcaccatgttagccagaatggtctcgatctcctgacctcgtgattcacccgcctcggcctcccaaagtcctgggattacaggcgtgagccaccaggcctagcagtggtattataatcttaagataggtgaaaagatactaaagacctttttggagaatgagaataccactgtcaatcaataaatccaactatattaaatagttttgtctagagctataatatagaggatttacgaaaactttgctttgtataacaaaggcagatattttatattctggttctatttttactttttctgatattaacttcagattttttattttggctttttttttgttttgtagagacaaggtctcactgtgtttcccaggctggtctcaaactcctgggctcaagctatcctcctgccttggcctctcaaagtgttgggattacaggcttgagccaccatgcctggtcaacatcaagttntaacatgatgttaattctatgtgttttaggactttgtagaataaggaaagaggcaaatatgggagatttgaagattttcagtgagacaggcaaagtaagttaacaatctgataggaaataatgtgacagaaggagaagttttcattgattagggccaggcactttatttgacttaaaataattagagctcagatagtattaggagtagcaactcaggtaggatattaattgaaggggacagaattgatgtgggtggtgggtagggcaaggacttaaaattgaccaaaaatacgtaacaatacgtatttctggggcctgaaggacaaaccctcactggttgtatttcttggctggcaggcttataacaagaagttttcaagggagactacatgttagttttttattttgcttgaagagagagatcatttccaagttgacttttgtcttctcagtgtaacatttggcacttcttttcctaaaattatcacttgtggctgagatacaagctgttgaattcagactataagctaaattgttggctctcgattattcttgagattgaaaatctttctggcatcaacaatttagatctatcaaaatgtgttaatagcagtaaatcttcaacttagagacttagaatatactgcaatatttcaattctgatgctaaccactcaaaagttagcatagaccccacaagttagaggcacagttcccaaaaagactgccctcacttcagatgcctgttgcaagttggggttgggggtcccaggccatcttcatttctgaccaactggctataaattggagggatcccttaagcctccttcaggctctataattagaacaactcacagaactcaggaaagtactatacatttgacccttgaacaacacgggtttgaactgcacaggtccacttactagtgattttttcccaacaaaaagtaaatcagaaatatagttggctgggtgcagttgctcacgcttgtaatctcagtactttgagaggccgaggaaagaggatcgcttgaggtcaggagtttgaggccagcttgcacaacatagcgagaccctgtcaccaaaaaaaatatttaaaaattagccaggcatggtgatgctttcctgtaatcccagttactgtggaggctgatcacttgagctcaggagtttgaggcttcagtgagctatgatcatgccactgcaacctagcctgaatgacagagcaagaccctgtctcn

SEQ ID NO: 65970 - DNA, 392 bp, Homo sapiens
aacgtggctgacaccaatctggaaggcgtcgactaagcctcaccgtgccttcagaggcttcttcctgcctctttgcatattcagcataacagcttgtcttccgaaaaaggcattaagggctagagatgtcaaatggaagagacttaggatcaagacattttttaatgttaggcagaacacattcattcagactttgctatttgttgtcaatttatagctgatttgaaggttttctatttaacactggttgacagtataattttcccaaagggcaacaaaacatacagatagcaaatttatattccttttctgttaagataatacttaaatttgttaatcaccagtaagatttgatgtttaaagacttccactgcaatatataaatactgaaa

SEQ ID NO: 65971 - DNA, 2226 bp, Homo sapiens
acttcctaaagttttagttctgagcttttattattttgggatattgtcatctttctaataggtagaattttagtgaaagtaatcaggaccttttcaagatagacttctgcataatttcatcctgtggctttggacgtactatccaaagaggctgtacatccagcaagtcactagttagtgaataggaattcttggcgtgtaatgccatttcttgtagctgaaggaagacatgtgataagtgattaacctgttctgtgcttcagttgactcttataaggacagtcattccctttaagcatcttaagacaaaaatatttatctgttgaattggaatttactaacagagggaatttgaattggaatttacttccagctgcactcatgcaagaatttgtgatgtatactaaaaaataaaaaaaggctcattcaggagagccttgtactcagcaagagtggctaacattagagcatacagactatgtgattgtataaggcatggagagttaaacaacctccagtcagctgcctgtttgaataccactgacttgttaagaatgatcttgcttttagattttaccatattcaaacttattaggtgagccttatatagcatatatacctggctgctattgtggggtttgggaacatgaggggtggggtgaactgttgttgttttaggtttcagtcagacagacatccctgtgcctcagttcccagaagcacagcaggcctctaggagcatccgtgggaacggcgcagtcctgacatcaccaactctcctgctcaggctcatcccatatacagaggtcaaagggtggggtttgagatcgggggaaggaatgagaaagtagaagcaatgtcacttcagtgccactgttgactagtctttggtgcttatgtcagtatttgttttatttcctgatttttttaaagttggcaaaactacatatttttatcttgatgaaggcagtgggagggtggaacaaaaacaagccattactgctatttctagttcatttactggagactgtcccttaatagctaatgtagaataaatttgaaacatagacctagatgacaaaaagaatgggaatagaaatgaatctcaggatttgaacaaacagaagacgtttatgctgtgttgatgcccagttctacaactgctattacatttgtcattctgtctccccttttcccctaattcttttatgtatgtatgtatacagtttgaggaaatgtgcatctatggtcagtcctttttaaaagacttaatgaatttattactcttttgcaaaaaatatacccactgcttatatgggcatacaaatgctaccctattttaaatgtaggtggcgtatgtgttcgtgttttaatgtattcagagccattgggcaataagcagtccagaacattgaaaactcaagcaggtaaagcacctaacacccttagtttctagaattactttaaaaaacttttatattgctgcatcttccacagttctttgggtagtctctgaacttaaaatttgtaggagttgtagactacctaaatttttaagttatggtatttgttcataggttgtaggggtaggtaaagaaggaaacagacaagaaaatggcttcttgaggtggcagctgctgagtggctaaatcttaccactttctttctactttttttggaaattttcccagcttagcatgaacatggatcatacagtgtttgattttatgtgattgagatttttgttttttatttttggagggaaggtcttggagaaacattaaaaagttggtgtatgtgcaaaaatacgaaatgttaaacaaaggaattttttcttatttaatctgaatggtaagcaagaactttttctatatacccttctgctgcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgct

SEQ ID NO: 65972 - DNA, 1931 bp, Homo sapiens
acttcctaaagttttagttctgagcttttattattttgggatattgtcatctttctaataggtagaattttagtgaaagtaatcaggaccttttcaagatagacttctgcataatttcatcctgtggctttggacgtactatccaaagaggctgtacatccagcaagtcactagttagtgaataggaattcttggcgtgtaatgccatttcttgtagctgaaggaagacatgtgataagtgattaacctgttctgtgcttcagttgactcttataaggacagtcattccctttaagcatcttaagacaaaaatatttatctgttgaattggaatttactaacagagggaatttgaattggaatttacttccagctgcactcatgcaagaatttgtgatgtatactaaaaaataaaaaaaggctcattcaggagagccttgtactcagcaagagtggctaacattagagcatacagactatgtgattgtataaggcatggagagttaaacaacctccagtcagctgcctgtttgaataccactgacttgttaagaatgatcttgcttttagattttaccatattcaaacttattaggtgagccttatatagcatatatacctggctgctattgtggggtttgggaacatgaggggtggggtgaactgttgttgttttaggtttcagtcagacagacatccctgtgcctcagttcccagaagcacagcaggcctctaggagcatccgtgggaacggcgcagtcctgacatcaccaactctcctgctcaggctcatcccatatacagaggtcaaagggtggggtttgagatcgggggaaggaatgagaaagtagaagcaatgtcacttcagtgccactgttgactagtctttggtgcttatgtcagtatttgttttatttcctgatttttttaaagttggcaaaactacatatttttatcttgatgaaggcagtgggagggtggaacaaaaacaagccattactgctatttctagttcatttactggagactgtcccttaatagctaatgtagaataaatttgaaacatagacctagatgacaaaaagaatgggaatagaaatgaatctcaggatttgaacaaacagaagacgtttatgctgtgttgatgcccagttctacaactgctattacatttgtcattctgtctccccttttcccctaattcttttatgtatgtatgtatacagtttgaggaaatgtgcatctatggtcagtcctttttaaaagacttaatgaatttattactcttttgcaaaaaatatacccactgcttatatgggcatacaaatgctaccctattttaaatgtaggtggcgtatgtgttcgtgttttaatgtattcagagccattgggcaataagcagtccagaacattgaaaactcaagcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctcagacagcaaacagaacacgccacagcagacacacgggcggcgaccaccccgcgccgggaacgccttgttcaggccaccataccctgagcgtaccggcacacagagagggcagggacacaggcacacaagcgcgccctgagaagccgacaccacacacacagaaccc

SEQ ID NO: 65973 - DNA, 1764 bp, Homo sapiens
acttcctaaagttttagttctgagcttttattattttgggatattgtcatctttctaataggtagaattttagtgaaagtaatcaggaccttttcaagatagacttctgcataatttcatcctgtggctttggacgtactatccaaagaggctgtacatccagcaagtcactagttagtgaataggaattcttggcgtgtaatgccatttcttgtagctgaaggaagacatgtgataagtgattaacctgttctgtgcttcagttgactcttataaggacagtcattccctttaagcatcttaagacaaaaatatttatctgttgaattggaatttactaacagagggaatttgaattggaatttacttccagctgcactcatgcaagaatttgtgatgtatactaaaaaataaaaaaaggctcattcaggagagccttgtactcagcaagagtggctaacattagagcatacagactatgtgattgtataaggcatggagagttaaacaacctccagtcagctgcctgtttgaataccactgacttgttaagaatgatcttgcttttagattttaccatattcaaacttattaggtgagccttatatagcatatatacctggctgctattgtggggtttgggaacatgaggggtggggtgaactgttgttgttttaggtttcagtcagacagacatccctgtgcctcagttcccagaagcacagcaggcctctaggagcatccgtgggaacggcgcagtcctgacatcaccaactctcctgctcaggctcatcccatatacagaggtcaaagggtggggtttgagatcgggggaaggaatgagaaagtagaagcaatgtcacttcagtgccactgttgactagtctttggtgcttatgtcagtatttgttttatttcctgatttttttaaagttggcaaaactacatatttttatcttgatgaaggcagtgggagggtggaacaaaaacaagccattactgctatttctagttcatttactggagactgtcccttaatagctaatgtagaataaatttgaaacatagacctagatgacaaaaagaatgggaatagaaatgaatctcaggatttgaacaaacagaagacgtttatgctgtgttgatgcccagttctacaactgctattacatttgtcattctgtctccccttttcccctaattcttttatgtatgtatgtatacagtttgaggaaatgtgcatctatggtcagtcctttttaaaagacttaatgaatttattactcttttgcaaaaaatatacccactgcttatatgggcatacaaatgctaccctattttaaatgtaggtggcgtatgtgttcgtgttttaatgtattcagagccattgggcaataagcagtccagaacattgaaaactcaagcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgct

SEQ ID NO: 65974 - DNA, 359 bp, Homo sapiens
  misc_feature (201)..(201): n is a, c, g, or t
tcgtgccgaattcggcacgagcggcacgatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttnctatttaagcttccttaatattatatattataaaacttatgtgatacaaaatttccattacctatgtaaaagattttgactttctatataaaaagagctgactgacattatctttaagtactttgtactaactttattttacttactgtatcattgat

SEQ ID NO: 65975 - DNA, 271 bp, Homo sapiens
tttttttttttcttcttaaaaaaacaaaacaaagtttcatttaaaatacatttaggcacctttggagcttggattttggaatgtttcagtagtggacagaaatctgctgttggaatcttctagtcttccaggtttaatttgaaatgtttttagttttgttttggatttttgtgtggtattttatttcctttataccaatgccattttgccatgtccccgtacatcgttagaagcttgaattcgagcagtagtagtagtagtaggcggccgc

SEQ ID NO: 65976 - DNA, 6700 bp, Homo sapiens
ggcacgagggggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcttaaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacagccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacaggtggcgtatgtgttcgtgttttaatgtattcagagccattgggcaataagcagtccagaacattgaaaactcaagcaggtaaagcacctaacacccttagtttctagaattactttaaaaaacttttatattgctgcatcttccacagttctttgggtagtctctgaacttaaaatttgtaggagttgtagactacctaaatttttaagttatggtatttgttcataggttgtaggggtaggtaaagaaggaaacagacaagaaaatggcttcttgaggtggcagctgctgagtggctaaatcttaccactttctttctactttttttggaaattttcccagcttagcatgaacatggatcatacagtgtttgattttatgtgattgagatttttgttttttatttttggagggaaggtcttggagaaacattaaaaagttggtgtatgtgcaaaaatacgaaatgttaaacaaaggaattttttcttatttaatctgaatggtaagcaagaactttttctatatacccttctgctgcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgct

SEQ ID NO: 65977 - DNA, 2569 bp, Homo sapiens
ggcacgagggggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataaaaaaaaaaaaag

SEQ ID NO: 65978 - DNA, 6258 bp, Homo sapiens
ggcacgagggggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcttaaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacagccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacaggtggcgtatgtgttcgtgttttaatgtattcagagccattgggcaataagcagtccagaacattgaaaactcaagcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataaaaaaaaaaaaag

SEQ ID NO: 65979 - DNA, 6238 bp, Homo sapiens
ggcacgagggggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcttaaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacagccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacaggtggcgtatgtgttcgtgttttaatgtattcagagccattgggcaataagcagtccagaacattgaaaactcaagcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgct

SEQ ID NO: 65980 - DNA, 6089 bp, Homo sapiens
ggcacgagggggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcttaaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacagccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacaggtaatttaactctttctcctttctttccatcactaggctaactttctttttttaaaacttcctttctttacgtactttaaaaagtaaccatgggtttgtcataattctcacttaaaaataatgcataaatgtatctagcaaataatatgattaaagaagagcttttgggggtaaagtttgacttggttatgatatactcaagacttgggaattttgtttagccatttagatgactccatttcttgcatatatgtctataattaagt

SEQ ID NO: 65981 - DNA, 1450 bp, Homo sapiens
tttttttttttcttcttaaaaaaacaaaacaaagtttcatttaaaatacatttaggcacctttggagcttggattttggaatgtttcagtagtggacagaaatctgctgttggaatcttctagtcttccaggtttaatttgaaatgtttttagttttgttttggatttttgtgtggtattttatttcctttataccaatgccattttgccatgctgttttggggtggctgcctaactctagtgaaaattctttctatattaatgaaagtttggcctttgaagatccttaatgttttgcattttttacattgtttttaaagaaatattctaactgcttgcactgttactgttctttaccagccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacaggtggcgtatgtgttcgtgttttaatgtattcagagccattgggcaataagcagtccagaacattgaaaactcaagcaggtaaagcacctaacacccttagtttctagaattactttaaaaaacttttatattgctgcatcttccacagttctttgggtagtctctgaacttaaaatttgtaggagttgtagactacctaaatttttaagttatggtatttgttcataggttgtaggggtaggtaaagaaggaaacagacaagaaaatggcttcttgaggtggcagctgctgagtggctaaatcttaccactttctttctactttttttggaaattttcccagcttagcatgaacatggatcatacagtgtttgattttatgtgattgagatttttgttttttatttttggagggaaggtcttggagaaacattaaaaagttggtgtatgtgcaaaaatacgaaatgttaaacaaaggaattttttcttatttaatctgaatggtaagcaagaactttttctatatacccttctgctgcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgct

SEQ ID NO: 65982 - DNA, 930 bp, Homo sapiens
tttttttttttcttcttaaaaaaacaaaacaaagtttcatttaaaatacatttaggcacctttggagcttggattttggaatgtttcagtagtggacagaaatctgctgttggaatcttctagtcttccaggtttaatttgaaatgtttttagttttgttttggatttttgtgtggtattttatttcctttataccaatgccattttgccatgctgttttggggtggctgcctaactctagtgaaaattctttctatattaatgaaagtttggcctttgaagatccttaatgttttgcattttttacattgtttttaaagaaatattctaactgcttgcactgttactgttctttaccagccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataaaaaaaaaaaaag

SEQ ID NO: 65983 - DNA, 1044 bp, Homo sapiens
ctcctttcccctccccaccatgggaagaatttagaaccatatatcaaaaacagccacttccgttggcacagaaatagacaaatagagcagtggaacaggctagagaattcagaaataaattgaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataaaaaaaaaaaaag

SEQ ID NO: 65984 - DNA, 1242 bp, Homo sapiens
tgccgggtagttctctccttcctttctctcctgccttcctttctcttgctgtctcgtccttttctttctttctctctttcttttctttctctccttccttctttccttcgctttctttctctctttccttcctttcgctccttttctccttttctttctttctctccttccttccttcctttctctccttctctctctctctctttctttctttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacaggtggcgtatgtgttcgtgttttaatgtattcagagccattgggcaataagcagtccagaacattgaaaactcaagcaggtaaagcacctaacacccttagtttctagaattactttaaaaaacttttatattgctgcatcttccacagttctttgggtagtctctgaacttaaaatttgtaggagttgtagactacctaaatttttaagttatggtatttgttcataggttgtaggggtaggtaaagaaggaaacagacaagaaaatggcttcttgaggtggcagctgctgagtggctaaatcttaccactttctttctactttttttggaaattttcccagcttagcatgaacatggatcatacagtgtttgattttatgtgattgagatttttgttttttatttttggagggaaggtcttggagaaacattaaaaagttggtgtatgtgcaaaaatacgaaatgttaaacaaaggaattttttcttatttaatctgaatggtaagcaagaactttttctatatacccttctgctgcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgct

SEQ ID NO: 65985 - DNA, 3515 bp, Homo sapiens
ggcacgagggggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcttaaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataacacgttcgcgagggtaccggctcgattcgtatcgg

SEQ ID NO: 65986 - DNA, 440 bp, Homo sapiens
tgctggtgttctagaggatcccagtgtcatgtattcagagccattgggcaataagcagtccagaacattgaaaactcaagcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataaaaaaaaaaaaag

SEQ ID NO: 65987 - DNA, 413 bp, Homo sapiens
ttgcctctaggtggtactccatccaagaactttttctatatacccttctgctgcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataaaaaaaaaaaaag

SEQ ID NO: 65988 - DNA, 442 bp, Homo sapiens
ttgtaaaacagtaatagatttagcttttattttttaatgataagaacattaaatgtcttctaagtcagaatcagagtatatctttgttaactgagctcaccaagacaaagtgataataacacaaaactgtggtttttggtagtctaatcaatttagaatgttttattgtcatgttagttgattttctgtctttatttgtattttttcttatcctggttatagagacttttaaaatctatgatttaaataagttgtgtttttcccccctaggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgct

SEQ ID NO: 65989 - DNA, 5728 bp, Homo sapiens
ggcacgagggggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcttaaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacaggtaaccactgctgctactgtttttatttgtttgtttgttcaattttatttaagatttgtttttgttgtactaggattttaaaaaatgtaatatattgcaggatttataaccaggatca

SEQ ID NO: 65990 - DNA, 6180 bp, Homo sapiens
ggcacgagggggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcttaaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacagccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatggttcttttgaagtaaccagtgatcttttttgcttaccctcatcaacagaatggatgaagatagatttgactgtgtgctttttcaagtggagaatatgaatatacagaacaagaaagcaataactccaacctgtttgattccgtctgttttctaaataaagacactatgcgctggaaataaaaaaaaaaaaag

SEQ ID NO: 65991 - DNA, 6672 bp, Homo sapiens
ggcacgagggggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcttaaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacagccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacaggtggcgtatgtgttcgtgttttaatgtattcagagccattgggcaataagcagtccagaacattgaaaactcaagcaggtaaagcacctaacacccttagtttctagaattactttaaaaaacttttatattgctgcatcttccacagttctttgggtagtctctgaacttaaaatttgtaggagttgtagactacctaaatttttaagttatggtatttgttcataggttgtaggggtaggtaaagaaggaaacagacaagaaaatggcttcttgaggtggcagctgctgagtggctaaatcttaccactttctttctactttttttggaaattttcccagcttagcatgaacatggatcatacagtgtttgattttatgtgattgagatttttgttttttatttttggagggaaggtcttggagaaacattaaaaagttggtgtatgtgcaaaaatacgaaatgttaaacaaaggaattttttcttatttaatctgaatggtaagcaagaactttttctatatacccttctgctgcagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatgaatggatgaagatagatttgactgtgtgctttttcaagtggagaatatgaatatacagaacaagaaagcaataactccaacctgtttgattccgtctgttttctaaataaagacactatgcgctggaaataaaaaaaaaaaaag

SEQ ID NO: 65992 - DNA, 6156 bp, Homo sapiens
ggcacgagggggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcttaaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttaggttaaacttattttcataattgtttaataacttttgtataatcttcattgctattatgagagagaatgtatatatcaaatatgtgtaatgataaaatctgaattgtaaaatttttgtatattgttaaaattgtaattctaaattgtatttcaaaaatgattatttctgatattgtttttatgtcacccatgatgaaaactggactttatatatctaaacatacaagtatgaactattctatttaaaatttttaatagtttttttcttttttggtgcctataattgattggtcatttctgctggcttttctccaatgaacattgaaatcttcctgtatatgttaccaataagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacagccttttcaggagccaaaaaaacaaatacaaacaaacaaaaaaatacccagagaaaaaactttccttcttcccccttcctgatgatgagtgagaagtattgagaactttcggggtcagtgcccttctaaactccccttcccccaataatgcagctgtataatgaatggtaaatgcaccggtttggattcaggcacagccccagtctgcctacagcagacaactaaactggtaggtggcagcagaggaaggaattcttcagattgatggctactgacttaaagtctgcataggagaagagatagagcatgacataccaagtgaagcaagggggacaaaaatggaaacaggactaagattcctgcattttgactctaaatgtcttttgaagtaaccagtgatctttttttgtcacctcgatcatgaataaatactctgtgatttggggttagtatagttttggttgttttcccttctcctgagatttcagaaataaaagattcctattccgtgatttttttgtcacctcgggatcctctggaacgatca

SEQ ID NO: 65993 - DNA, 5574 bp, Homo sapiens
ggcacgagggggagtgagagtgtgtgggagtggggtgagggagaagctgacgggacgcgaggctgtgagaaactgggcgagtgtgcgaggacgcccggccagcctgcgggagccgcagtcggcggaggagaaaggaggcggctcccggtatcccgaccccctccccctcctctccttcccccacttccagccgcccggcggcccgcgcttcctcgaaggccccagcccggctcagtcggccgagagcgagggaggagccccccgacccaggtgctggagtctgcttgtcagggaggggggcagtctgtgattctgagaacagagccaagaaggggaacagcaaattcagtcacagacaatcctccactcggtcaagagccacttttctcttcctgccttgcccccccgcagggggtaaggaactgagcgtttaatctttagccggttggctaccagctaaaattctacttatcttagtttctagtggatagctttcttattttgcccatgttttcttagaatccctgtttaatatacttttgtcagtagtagtatctaggagtagcagggagagtgacaataaattagccccttcttttttcccttgtcattcaggccccttttcctctccagagggaaattaccagtaaactcttctaaatcttccaccccttctcagtcatactgtgaagaaacacactaaagtggacattatttgaccagtgaacacgaacccagcttcaggcattggtttgttgtggcacatggagaaacatctcttttaaaatatctcccaattacccttttcacaatttgtatccacctaggatttgctgctggggtaagtcactagatttatttctcaaagctcccctctctatgagctgaaagactgaccaaccatgaacactagtaggggatggggaaaggggacagagcagagccagttgttccacactttgggaagcaggagtagcttttatcatcttcctctggggagcaggcatagagacataaactgagtgaaaatgggtggaggaagaacttctatacccacgaacaacatgtgaagagagagaaccaaacataaagtaaggagggtagacgttacatccaagaggaaataatccaggcaaggaagcacaagctgatcaagatgtgtagttctgtggctgccaagttgtggtttttgacagatcgtcgcatcagggaagactatcctcaaaaagagattttacgagcattgaaggccaaatgttgtgaggaggaactggactttagggctgtggtgatggatgaggtggtgctgacaatcgagcaaggaaacctgggtctgcggatcaatggagagctaatcactgcctacccacaagtggtggtagtcagagtaccaaccccttgggtgcaaagtgatagtgacatcactgttttgcgccatctagagaagatgggatgtcggttaatgaaccgacctcaagccatcctgaactgcgttaataagttctggacatttcaagagttggctggccatggtgttcctctgccggatactttctcttatggtggccacgaaaattttgctaaaatgattgatgaggctgaagttctggagttcccaatggtagtaaagaatacgcggggtcacagaggtaaagctgttttcttggctcgagataagcaccatttggctgatctaagccatcttattcgccatgaagcgccatacctgttccagaagtatgttaaagagtctcatggacgggatgtacgtgtcattgtcgtgggaggccgtgtggttggcaccatgttacgttgttcaacagatgggagaatgcaaagcaactgctcattaggtggtgtggggatgatgtgctcattgagtgaacaagggaagcagctagctatccaggtgtctaatatcctggggatggatgtgtgtggcattgacctgctgatgaaagatgacggctccttctgcgtctgtgaggccaatgcaaatgtaggtttcatcgcctttgataaggcttgtaatctagatgtagctggtatcatagcagactatgccgcctcccttctaccctctggccggctcacccggcgtatgtccctgctctccgtggtgtccactgccagtgagactagtgagccggagctgggtcccccagccagcactgctgttgacaacatgagtgcaagttccagctctgttgacagcgaccctgaaagcacggagcgagagctgctcaccaagctcccagggggcctgttcaacatgaaccagctgctagccaatgaaatcaaactactggtggactgactccactggtaattaaccaacaaaacccttgtaaaactttctttcttcttttctatttttaaaaccaacttgcaatgctgttcatggaggatgctcaggaagatgagagaaaattagtaggattagttggagagagtgggagatagatgagacctctgctagtaagatgttactttcatttacaaatcctacaaatagagaggcagaataggtggggtatagaaaaatgtcaggctctcatagttacccttttaaattgctaaaaaatgtgtatgctcataggccatgaggaacaaatactttttttttttcatggtcccttgcttttgtttttgtacaaaaaaaaatggttttgctacaaatatccaagtagcataacttcacattgtgttggaagatttgtcatcagtgaggaaaacatctgcttaaattacaggaatttttgtattatacagctctgaaaattctgccatttccttattaactagcagctttagtttgtagtttatgaaatcttgaggggctcttttactgggatttcttatttttttgttttttcccgcttaatttggtgggaggtcaaattgaatataacccaataaaggcttcttaatgacaaaattggcatgtttgcatgatgaaatggaaatgaacagtattgcaatgtccggtatacaaaataacattaattcaatgtagataaaattacactagtttaaaatatgtgcattcacttgtatttgttagtgttttagtcttttttgaaagatgtgctctgttaatgttgcttttttttttttttttaatacatgctagtctaacatttcctgctctatgcctgcatctttaacaatggccaaagtgaagaaaatgctaccttttttgttaacaagacactgacttgaaacatgtacatttaaagccttttattttttccctttttgttttggtagttgggcatttaaataaggacaaggaaaaatatttttgggggcaaatcaagagcctatgagttctaagtataaagctgaagtgatttcgaatgccagcgttatatatttgcatttttcacattttacgagggagtatatgtgtatgtgtgtgcacgcatgcatgtgtatgtgttttgctttttgtttccatcaactaatcaaaaaggataatttagaaaatggagcatgatgggaaacagagtttttgactttaaaaaacagatgagttgttttcataagtagactccactggggtagaggtattcaccttaaaacatagggtgagtagatgcttttttaggcctttttgtgtatatgtacgttgtttgtttttttccttttgtttctagcctgttcagtgtacagtttattcaaggctacatgcttttctttaatgcttctggctatgcattttctctttttacatataggatttgggattgggggtgggttggatgtttttgtttggggacttatttagtagtattgagtctcttatagccctactcttaagccttcaatactgtccactctttatattcctttacttgcagaatttataaaagcccccaaactgcatataatatgagcctttaaaacatgggtaaaactaatcccattgatgggtttggatggtatgttaagaaatggagatgctgcagagcccaacgtaattttttaaacagcaagttttccatctccctacgaatcctctgaagcttttacccaagccctttcttgcctctccagtgctattttccttcagatggaccttaaacataatttcttggacactactagagagacttcgaggcaataataaaagatcagtattaaccagctataacagaggtttgatcatgcttacttgtacagtttttcccccgttttaaaaaggaatgtaataaaatttgttttttccatagaattaaataatattaaaattgagtgaaaggttgattgttgatgaatagaatagtacctctcatctgtgcagtgtctcatttcacctcagagaaaaggatacataagaggagtttgtaatttatcttaggatattctaattgcatttaaaagaacttatcttgcgcagggtaaatgggggactcacatacatatattaatacctctgactcattaacagaaagaaatacttggtacttctttcgctgaatgaccatactgtggaggatgcatactatttggtatagagaaataaatgaggaagaaagaactgcttaattaaattatcattcatatgttcatatagagaccatctggttgccatgtgtattatgacacatacactttgaatagttacatatcacaagtatgtagttcatgtttgtgttggtggggtaaggcatcaggaaaaatgtagttagtcttttcttaacttataccaaattaaccaactatattataggaaatatgtgaaattagttcattagctttattcactattatgcattcacatgatattaaaacgtacactcacatgttagaatgaaaagagcagtagttatcttagattttaaaaacatggatatcttcttgaattccttcaagattgaggtagagaataagagcaaatcattctggaagtaccttaaggaaacaaacagcagcagatatttagaaaactaccctggaacagtagaaaaacccaacaagagacttggcattcatcaagcacattatcagactttgagaacatattgaaggcattgactttgaaaatcatctctttttctcaagaagaaagcaatggagaagcaaatttgtttcattcagtgaatccccagtttggggcttgtggggcttagagacattgtgaaatcaaatcttgtgttatacttttctcctggctcactttttttgagaaggtttatgggctatttggctggtgagacacgatcccctcctaagaaaatgtaggtgctcagacagccttttcaggagccaaaaaaacaaatacaaacaaacaaaaaaatacccagagaaaaaactttccttcttcccccttcctgatgatgagtgagaagtattgagaactttcggggtcagtgcccttctaaactccccttccccaaaaggaggcggtatgaaggtgatggccggcgggtttagagaggccctctggctcgaaccaacggggggggggcggaagagaccccaagaggcgcgcactgggtggaaaagaaacgatcccccccgggagcggaagcaaaccatcgcagggagcaagtccccacgagaaggtag

SEQ ID NO: 65994 - DNA, 2135 bp, Homo sapiens
ttcccacaaaagctaggctggttctgattcttaacctgctccagcagtgacacactcagtcccacagggagtggacgacccccaggaagaagatgatgttttggaggaaactccccaaagccctcttcattgggctgactctggccattgctgtcaatctccttctggtattttctagcaaggggactttacaaaacctgtttacgggtggtctccacagggagcttcctttacatctgaataaacgctacggggcagtgataaagagactctcccacttggaggtggaattgcaggatctgaaagaaagtatgaaattagctctgaggcaacaagaaaatgtgaacagcacactgaagagggcgaaagatgaagtacgccctcttctaaaggcaatggaaaccaaggtgaatgagacaaagaagcacaaaacccaaatgaaactcttcccacactcacagcttttcaggcaatggggcgaggatctttctgaggcccagcagaaggcggcccaggacctcttccggaagtttggttacaacgcgtacctcagcaaccagctgcctctcaatcgcaccatccccgacacgcgagactacagatgtcttcggaagacatatccttcccaactcccatccctcagtgtcattctcatattcgtgaatgaagctctgtccattatacaacgggccatcaccagtatcatcaaccggacgccctctcgattgttgaaggaaatcatcttggtggatgatttcagctcaaatggagaactaaaggtacacttggatgagaagattaagctttacaaccagaagtatccaggactactgaaaataatacggcatcctgaaaggaaaggtcttgctcaagcccgcaacactggctgggaagctgccacagcagacgtggtcgccatcttggatgctcacattgaagtcaatgttgggtgggcagagccaatcttggctcggattcaggaggaccgcactgtgattgtgtctcctgtgtttgacaacattcgttttgacaccttcaaactggataagtatgaactggcagttgatgggtttaactgggaactctggtgccgctacgatgcactgccacaagcctggattgatctgcatgatgtcactgccccagtgaagagtccttcaatcatgggcatcctggctgctaacaggcacttcctgggagagatcgggtctctggatggtggaatgctcatctatggaggagagaacgtggagcttagcctgagggtgtggcagtgtggagggaaggtcgagattttgccctgttcccggattgcccacctagagagacaccacaagccctacgccttggatctcaccgctgccttgaagcgcaatgctctgcgagtggccgaaatctggatggatgagcacaaacacatggtctacttggcctggaacatacctctccagaactctggaatagattttggagacgtttcttccagaatggcactccgggaaaaactgaaatgtaaaacttttgactggtacctgaaaaatgtttatccactcttgaagccactccacaccatcgtgggctatggaagaatgaaaaacctattggatgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgggaggagctgtcataaacagagataccaagcggtgtctggagatgaagaaggatcttttgggtagccacgtgcttgtgctccagacctgtagcacgcaagtgtgggaaatccagcacactgtcagagactggggtcagaccaacagccagtgatcctcagatggtgctggatctgggtcatcaattcttgcaagtggaatggcttctactcctaacactcccagcttctttctcaatgagaaagaaagcatgtgtatgtctgtttatggcgacttcaggtgg

SEQ ID NO: 65995 - DNA, 520 bp, Homo sapiens
gggactcggtaggagctcactaggcaaatgccagcggggtgaggaaggacactggtgtgtccaggtttctcagttccatccctcatgcgacacaacctcatatcactaactacacgtccttttgttctggttcctccctggcaggaaaaaatgctggcaggtggtgcaagcaaggacatctatgcatagaattctgacagcagctggaccctcaacttcttcagaagatgagaaacctgcctggcaccgctggcaggcatctggactgacaccgctctggaggcctcccacaagcagcaaccaagccagaaaaagttgagaccagacccgctgtccctaaagatggggcccagaatgtcggggtgaagctgtaggaacagggtgaaagctggtggtgtgagcaaagagaccagctatggggtggtcaggggattccgggaggtgcatgggtatgttgcagacccccccaggacaagggtggctgtggaagaatggcaaataaacacaaggcaaagtctca

SEQ ID NO: 65996 - DNA, 263 bp, Homo sapiens
gaagaatcaggagtaagatgaggcagcttcaatgactgggtggggaaactaggaagaaaagtccagacaggaagctttgaggccctgcttcctccacattgtcctgagtgctggggcttcatgacgttgctgcagaagtctggacagcagggaccgtagccttcgccatgtgtctagcagagcacctgatacagaattgtcactcatacaatgtgtggtgaatgaatgagtgaggaaataaatgaaggaagtgctggaactgg

SEQ ID NO: 65997 - DNA, 2055 bp, Homo sapiens
tatgctttcagactctttgatgataattttttttttaaaaattattctctcgaagagcaacttacgagaggacagccttatgagggtttgcttgagaggcagtgtggcttctgtgactgccagctctaaatctcgatcttgccataactttacagggtaacttgggtccacagtcactctttgtgcctcagtttacccacccattaaatgggaacattactgtcttcccctccctacctcatggggaatgtctgggaagctggggacattgctatgcaaatgtgtgaatcttagtcatggatttgatttttagttatccccatacccccataggcaaggccttcccccagagttcctgctttggatccaaagcctgagaataggccattatggaccattggctccctaaatccctccttggcctcttggactgagcccctcagcctttcttcttacccttcagaaaggagagttctctttagatatgttcagggggatccttccatggctggaggtcaccttgactgggggcttggcttctccaaacctgaaacacagtagaagatagagatgtttatgatgcaaaaacctgctctgaggtcagaaagtgctagttttccaaatctctcccattgctgctggctatctggggaaagaagagaaaagcccattccagaggcagaagggaagctcccagccgagggtaaaagttgagacctgtatgcatgtatctctgtatatgtgtatgtaatcaccctcatcaccatccctgagaaaacattttcttttcaagtcagagcacgcctgaaagggtttgtggagagcccagctcaccagggactctggttgccgtagcaaccttccagactgttctctctatcttctgctttgggcatcaagggagaccaggggactacatcttcccagcttctcaaatgggagcacctcccacatcgtggcttaggggctgggagtgccagggcacggatgtgggacttttggaaaatgtggaggaagcagggcctcaaagcttcctgtctggacttttcttcctagtttccccacccagtcattgaagctgcctcatcttactcctgattcttcagaaatttgaatgttaagcaaccagttaaaccaacgtcagtattaattttttcaagctgtcgaggggagcccttagaggggacaacttcttggagtggcggccaagctgggccttaccaggtgtgatcatagtcttaggtatcatggagttcccatctccgcagaggcaggctcttcccagctccacgagaggcggagaattgcaacttcttcctctctgggaacggcctatctagctcctgggaggaatctcaaagatctttcttcttaagacatcgaagaaaaactgagaggctgtagctcgacctagtttctgtgaagaattttgtcaagtgatccctctcggaccctgagcctctttatttggattttgtgccttgagcaccaagagaatatgcactctgggttgcctggacagctggggtggtgattcacaggaagggtccaagccatcactacacctgactcaagccggaaagagctcccagaggacttcctggagctgccagcctcagcctgagatgcgggatattcgtccccaaggagcgaggagggacagctcgccttctttgcaggaaaaaatgctggcaggtggtgcaagcaaggacatctatgcatagaattctgacagcagctggaccctcaacttcttcagaagatgagaaacctgcctggcaccgctggcaggcatctggactgacaccgctctggaggcctcccacaagcagcaaccaagccagaaaaagttgagaccagacccgctgtccctaaagatggggcccagaatgtcggggtgaagctgtaggaacagggtgaaagctggtggtgtgagcaaagagaccagctatggggtggtcaggggattccgggaggtgcatgggtatgttgcagacccccccaggacaagggtggctgtggaagaatggcaaataaacacaaggcaaagtctca

SEQ ID NO: 65998 - DNA, 1940 bp, Homo sapiens
tatgctttcagactctttgatgataattttttttttaaaaattattctctcgaagagcaacttacgagaggacagccttatgagggtttgcttgagaggcagtgtggcttctgtgactgccagctctaaatctcgatcttgccataactttacagggtaacttgggtccacagtcactctttgtgcctcagtttacccacccattaaatgggaacattactgtcttcccctccctacctcatggggaatgtctgggaagctggggacattgctatgcaaatgtgtgaatcttagtcatggatttgatttttagttatccccatacccccataggcaaggccttcccccagagttcctgctttggatccaaagcctgagaataggccattatggaccattggctccctaaatccctccttggcttctccaaacctgaaacacagtagaagatagagatgtttatgatgcaaaaacctgctctgaggtcagaaagtgctagttttccaaatctctcccattgctgctggctatctggggaaagaagagaaaagcccattccagaggcagaagggaagctcccagccgagggtaaaagttgagacctgtatgcatgtatctctgtatatgtgtatgtaatcaccctcatcaccatccctgagaaaacattttcttttcaagtcagagcacgcctgaaagggtttgtggagagcccagctcaccagggactctggttgccgtagcaaccttccagactgttctctctatcttctgctttgggcatcaagggagaccaggggactacatcttcccagcttctcaaatgggagcacctcccacatcgtggcttaggggctgggagtgccagggcacggatgtgggacttttggaaaatgtggaggaagcagggcctcaaagcttcctgtctggacttttcttcctagtttccccacccagtcattgaagctgcctcatcttactcctgattcttcagaaatttgaatgttaagcaaccagttaaaccaacgtcagtattaattttttcaagctgtcgaggggagcccttagaggggacaacttcttggagtggcggccaagctgggccttaccaggtgtgatcatagtcttaggtatcatggagttcccatctccgcagaggcaggctcttcccagctccacgagaggcggagaattgcaacttcttcctctctgggaacggcctatctagctcctgggaggaatctcaaagatctttcttcttaagacatcgaagaaaaactgagaggctgtagctcgacctagtttctgtgaagaattttgtcaagtgatccctctcggaccctgagcctctttatttggattttgtgccttgagcaccaagagaatatgcactctgggttgcctggacagctggggtggtgattcacaggaagggtccaagccatcactacacctgactcaagccggaaagagctcccagaggacttcctggagctgccagcctcagcctgagatgcgggatattcgtccccaaggagcgaggagggacagctcgccttctttgcaggaaaaaatgctggcaggtggtgcaagcaaggacatctatgcatagaattctgacagcagctggaccctcaacttcttcagaagatgagaaacctgcctggcaccgctggcaggcatctggactgacaccgctctggaggcctcccacaagcagcaaccaagccagaaaaagttgagaccagacccgctgtccctaaagatggggcccagaatgtcggggtgaagctgtaggaacagggtgaaagctggtggtgtgagcaaagagaccagctatggggtggtcaggggattccgggaggtgcatgggtatgttgcagacccccccaggacaagggtggctgtggaagaatggcaaataaacacaaggcaaagtctca

SEQ ID NO: 65999 - DNA, 2875 bp, Homo sapiens
tatgctttcagactctttgatgataattttttttttaaaaattattctctcgaagagcaacttacgagaggacagccttatgagggtttgcttgagaggcagtgtggcttctgtgactgccagctctaaatctcgatcttgccataactttacagggtaacttgggtccacagtcactctttgtgcctcagtttacccacccattaaatgggaacattactgtcttcccctccctacctcatggggaatgtctgggaagctggggacattgctatgcaaatgtgtgaatcttagtcatggatttgatttttagttatccccatacccccataggcaaggccttcccccagagttcctgctttggatccaaagcctgagaataggccattatggaccattggctccctaaatccctccttggcctcttggactgagcccctcagcctttcttcttacccttcagaaaggagagttctctttagatatgttcagggggatccttccatggctggaggtcaccttgactgggggcttggcttctccaaacctgaaacacagtagaagatagagatgtttatgatgcaaaaacctgctctgaggtcagaaagtgctagttttccaaatctctcccattgctgctggctatctggggaaagaagagaaaagcccattccagaggcagaagggaagctcccagccgagggtaaaagttgagacctgtatgcatgtatctctgtatatgtgtatgtaatcaccctcatcaccatccctgagaaaacattttcttttcaagtcagagcacgcctgaaagggtttgtggagagcccagctcaccagggactctggttgccgtagcaaccttccagactgttctctctatcttctgctttgggcatcaagggagaccaggggactacatcttcccagcttctcaaatgggagcacctcccacatcgtggcttaggggctgggagtgccagggcacggatgtgggacttttggaaaatgtggaggaagcagggcctcaaagcttcctgtctggacttttcttcctagtttccccacccagtcattgaagctgcctcatcttactcctgattcttcagaaatttgaatgttaagcaaccagttaaaccaacgtcagtattaattttttcaagctgtcgaggggagcccttagaggggacaacttcttggagtggcggccaagctgggccttaccaggtgtgatcatagtcttaggtatcatggagttcccatctccgcagaggcaggctcttcccagctccacgagaggcggagaattgcaacttcttcctctctgggaacggcctatctagctcctgggaggaatctcaaagatctttcttcttaagacatcgaagaaaaactgagaggctgtagctcgacctagtttctgtgaagaattttgtcaagtgatccctctcggaccctgagcctctttatttggattttgtgccttgagcaccaagagaatatgcactctgggttgcctggacagctggggtggtgattcacaggaagggtccaagccatcactacacctgactcaagccggaaagagctcccagaggacttcctggagctgccagcctcagcctgagatgcgggatattcgtccccaaggagcgaggagggacagctcgccttctttgcaggaaaaaatgctggcaggtggtgcaagcaaggacatctatgcatagaattctgacagcagctggaccctcaacttcttcagaagatgagaaacctgcctggcaccgctggcaggcatctggactgacaccgctctggaggcctcccacaagcagcaaccaagccagaaaaagttgagaccagacccgctgtccctaaagatggggcccagaatgtcggggtgaagctgtaggaacagggtgaaagctggtggtgtgagcaaagagaccagctatggggtggtcaggggattccgggaggtgcatgggtatgttgcagacccccccaggacaagggtggctgtggaagaatggcaaataaacacaaggcaaagtctcagaggctgtgcattatgccatgagaaaacgtcgacggccaagttaggcagacaagccaagcggtctccacaagagtaggcagggatccaaaattcagagcacctgcagcttgctgggcatcctcactacacaggaggatgtgatggccacacatagatcaccaggaagaggacttgatcaccctctgccatgagccggcccacagataggggacattctgcaagaaagtaagatgcgtaacccatgatctaagagttatctgcctctgatagacacacgagtgggcaaatatcaagggcagagttatttttttgcatggacttcccagaggccagatgatgctgtgtgcggggtctcccaggtaacagtaaggatgttctttctagtcacccgcattgttcttgcaactgacagctgttctctcttggcctgtcctcagtggaagggggtaatgctacttcttaacaatcaaacaagcccttgcactcttctaggatctctggtgggggacattcccactgctagtcactcattcacgtatcttttccacttcctgacaaaatgaaggactaggatgattttcttgtgtggaattttgtttcctaatgaggtgttgctgaggctccaggttgctttaatgcccacaccctcccagattgtcctgagtgctggggcttcatgacgttgctgcagaagtctggacagcagggaccgtagccttcgccatgtgtctagcagagcacctgatacagaattgtcactcatacaatgtgtggtgaatgaatgagtgaggaaataaatgaaggaagtgctggaactgg

SEQ ID NO: 66000 - DNA, 1340 bp, Homo sapiens
gggactcggtaggagctcactaggcaaatgccagcggggtgaggaaggacactggtgtgtccaggtttctcagttccatccctcatgcgacacaacctcatatcactaactacacgtccttttgttctggttcctccctggcaggaaaaaatgctggcaggtggtgcaagcaaggacatctatgcatagaattctgacagcagctggaccctcaacttcttcagaagatgagaaacctgcctggcaccgctggcaggcatctggactgacaccgctctggaggcctcccacaagcagcaaccaagccagaaaaagttgagaccagacccgctgtccctaaagatggggcccagaatgtcggggtgaagctgtaggaacagggtgaaagctggtggtgtgagcaaagagaccagctatggggtggtcaggggattccgggaggtgcatgggtatgttgcagacccccccaggacaagggtggctgtggaagaatggcaaataaacacaaggcaaagtctcagaggctgtgcattatgccatgagaaaacgtcgacggccaagttaggcagacaagccaagcggtctccacaagagtaggcagggatccaaaattcagagcacctgcagcttgctgggcatcctcactacacaggaggatgtgatggccacacatagatcaccaggaagaggacttgatcaccctctgccatgagccggcccacagataggggacattctgcaagaaagtaagatgcgtaacccatgatctaagagttatctgcctctgatagacacacgagtgggcaaatatcaagggcagagttatttttttgcatggacttcccagaggccagatgatgctgtgtgcggggtctcccaggtaacagtaaggatgttctttctagtcacccgcattgttcttgcaactgacagctgttctctcttggcctgtcctcagtggaagggggtaatgctacttcttaacaatcaaacaagcccttgcactcttctaggatctctggtgggggacattcccactgctagtcactcattcacgtatcttttccacttcctgacaaaatgaaggactaggatgattttcttgtgtggaattttgtttcctaatgaggtgttgctgaggctccaggttgctttaatgcccacaccctcccagattgtcctgagtgctggggcttcatgacgttgctgcagaagtctggacagcagggaccgtagccttcgccatgtgtctagcagagcacctgatacagaattgtcactcatacaatgtgtggtgaatgaatgagtgaggaaataaatgaaggaagtgctggaactgg

SEQ ID NO: 66001 - DNA, 1890 bp, Homo sapiens
ttcccacaaaagctaggctggttctgattcttaacctgctccagcagtgacacactcagtcccacagggagtggacgacccccaggaagaagatgatgttttggaggaaactccccaaagccctcttcattgggctgactctggccattgctgtcaatctccttctggtattttctagcaaggggactttacaaaacctgtttacgggtggtctccacagggagcttcctttacatctgaataaacgctacggggcagtgataaagagactctcccacttggaggtggaattgcaggatctgaaagaaagtatgaaattagctctgaggcaacaagaaaatgtgaacagcacactgaagagggcgaaagatgaagtacgccctcttctaaaggcaatggaaaccaaggtgaatgagacaaagaagcacaaaacccaaatgaaactcttcccacactcacagcttttcaggcaatggggcgaggatctttctgaggcccagcagaaggcggcccaggacctcttccggaagtttggttacaacgcgtacctcagcaaccagctgcctctcaatcgcaccatccccgacacgcgagactacagatgtcttcggaagacatatccttcccaactcccatccctcagtgtcattctcatattcgtgaatgaagctctgtccattatacaacgggccatcaccagtatcatcaaccggacgccctctcgattgttgaaggaaatcatcttggtggatgatttcagctcaaatggagaactaaaggtacacttggatgagaagattaagctttacaaccagaagtatccaggactactgaaaataatacggcatcctgaaaggaaaggtcttgctcaagcccgcaacactggctgggaagctgccacagcagacgtggtcgccatcttggatgctcacattgaagtcaatgttgggtgggcagagccaatcttggctcggattcaggaggaccgcactgtgattgtgtctcctgtgtttgacaacattcgttttgacaccttcaaactggataagtatgaactggcagttgatgggtttaactgggaactctggtgccgctacgatgcactgccacaagcctggattgatctgcatgatgtcactgccccagtgaagagtccttcaatcatgggcatcctggctgctaacaggcacttcctgggagagatcgggtctctggatggtggaatgctcatctatggaggagagaacgtggagcttagcctgagggtgtggcagtgtggagggaaggtcgagattttgccctgttcccggattgcccacctagagagacaccacaagccctacgccttggatctcaccgctgccttgaagcgcaatgctctgcgagtggccgaaatctggatggatgagcacaaacacatggtctacttggcctggaacatacctctccagaactctggaatagattttggagacgtttcttccagaatggcactccgggaaaaactgaaatgtaaaacttttgactggtacctgaaaaatgtttatccactcttgaagccactccacaccatcgtgggctatggaagaatgaaaaacctattggatgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccgcctaccattactaaataaataattatgcattccaaaa

SEQ ID NO: 66002 - DNA, 2229 bp, Homo sapiens
ttcccacaaaagctaggctggttctgattcttaacctgctccagcagtgacacactcagtcccacagggagtggacgacccccaggaagaagatgatgttttggaggaaactccccaaagccctcttcattgggctgactctggccattgctgtcaatctccttctggtattttctagcaaggggactttacaaaacctgtttacgggtggtctccacagggagcttcctttacatctgaataaacgctacggggcagtgataaagagactctcccacttggaggtggaattgcaggatctgaaagaaagtatgaaattagctctgaggcaacaagaaaatgtgaacagcacactgaagagggcgaaagatgaagtacgccctcttctaaaggcaatggaaaccaaggtgaatgagacaaagaagcacaaaacccaaatgaaactcttcccacactcacagcttttcaggcaatggggcgaggatctttctgaggcccagcagaaggcggcccaggacctcttccggaagtttggttacaacgcgtacctcagcaaccagctgcctctcaatcgcaccatccccgacacgcgagactacagatgtcttcggaagacatatccttcccaactcccatccctcagtgtcattctcatattcgtgaatgaagctctgtccattatacaacgggccatcaccagtatcatcaaccggacgccctctcgattgttgaaggaaatcatcttggtggatgatttcagctcaaatggagaactaaaggtacacttggatgagaagattaagctttacaaccagaagtatccaggactactgaaaataatacggcatcctgaaaggaaaggtcttgctcaagcccgcaacactggctgggaagctgccacagcagacgtggtcgccatcttggatgctcacattgaagtcaatgttgggtgggcagagccaatcttggctcggattcaggaggaccgcactgtgattgtgtctcctgtgtttgacaacattcgttttgacaccttcaaactggataagtatgaactggcagttgatgggtttaactgggaactctggtgccgctacgatgcactgccacaagcctggattgatctgcatgatgtcactgccccagtgaagagtccttcaatcatgggcatcctggctgctaacaggcacttcctgggagagatcgggtctctggatggtggaatgctcatctatggaggagagaacgtggagcttagcctgagggtgtggcagtgtggagggaaggtcgagattttgccctgttcccggattgcccacctagagagacaccacaagccctacgccttggatctcaccgctgccttgaagcgcaatgctctgcgagtggccgaaatctggatggatgagcacaaacacatggtctacttggcctggaacatacctctccagaactctggaatagattttggagacgtttcttccagaatggcactccgggaaaaactgaaatgtaaaacttttgactggtacctgaaaaatgtttatccactcttgaagccactccacaccatcgtgggctatggaagaatgaaaaacctattggatgaaaatgtctgcttggatcagggacccgttccaggcaacacccccatcatgtattactgccatgaattcagctcacagaatgtctactatcacctaactggggagctctatgtgggacaactgattgcagaggccagtgctagtgatcgctgcctgacagaccctggcaaggcggagaagcccaccttagaaccatgctccaaggcagctaagaatagactgcatatatattgggattttaaaccggaaaaaatgctggcaggtggtgcaagcaaggacatctatgcatagaattctgacagcagctggaccctcaacttcttcagaagatgagaaacctgcctggcaccgctggcaggcatctggactgacaccgctctggaggcctcccacaagcagcaaccaagccagaaaaagttgagaccagacccgctgtccctaaagatggggcccagaatgtcggggtgaagctgtaggaacagggtgaaagctggtggtgtgagcaaagagaccagctatggggtggtcaggggattccgggaggtgcatgggtatgttgcagacccccccaggacaagggtggctgtggaagaatggcaaataaacacaaggcaaagtctca

SEQ ID NO: 66003 - DNA, 1430 bp, Homo sapiens
gaaggactggggaagactggatgagaagggtagaagagggtgggtgtgggatggggaggggagagtggaaaggccctgggcagaccctggcagaaggggcacggggcagggtgtgagttccccactagcagggccaggtgagctatggtgctgcacctactgctcttcttgctgctgaccccacagggtgggcacagctgccaggggctggagctggcccgggaacttgttctggccaaggtgagggccctgttcttggatgccttggggccccccgcggtgaccagggaaggtggggaccctggagtcaggcggctgccccgaagacatgccctggggggcttcacacacaggggctctgagcccgaggaagaggaggatgtctcccaagccatccttttcccagccacagatgccagctgtgaggacaagtcagctgccagagggctggcccaggaggctgaggagggcctcttcagatacatgttccggccatcccagcatacacgcagccgccaggtgacttcagcccagctgtggttccacaccgggctggacaggcagggcacagcagcctccaatagctctgagcccctgctaggcctgctggcactgtcaccgggaggacccgtggctgtgcccatgtctttgggccatgctccccctcactgggccgtgctgcacctggccacctctgctctctctctgctgacccaccccgtcctggtgctgctgctgcgctgtcccctctgtacctgctcagcccggcctgaggccacgcccttcctggtggcccacactcggaccagaccacccagtggaggggagagagcccgacgctcaactcccctgatgtcctggccttggtctccctctgctctgcgcctgctgcagaggcctccggaggaaccggctgcccatgccaactgccacagagtagcactgaacatctccttccaggagctgggctgggaacggtggatcgtgtaccctcccagtttcatcttccactactgtcatggtggttgtgggctgcacatcccaccaaacctgtcccttccagtccctggggctccccctaccccagcccagccctactccttgctgccaggggcccagccctgctgtgctgctctcccagggaccatgaggcccctacatgtccgcaccacctcggatggaggttactctttcaagtatgagacagtgcccaaccttctcacgcagcactgtgcttgtatctaagggtggggggtcttccttcttaatcccatggctggtggccacgcccccaccatcatcagctgggaggaaaggcagagttgggaaatagatggctcccactcctccctcctttcacttctctgcctatgggctaccctccccaccccacttctatctcaataaagaacacagtgcatatgacttga

SEQ ID NO: 66004 - DNA, 2081 bp, Homo sapiens
gaaggactggggaagactggatgagaagggtagaagagggtgggtgtgggatggggaggggagagtggaaaggccctgggcagaccctggcagaaggggcacggggcagggtgtgagttccccactagcagggccaggtgagctatggtgctgcacctactgctcttcttgctgctgaccccacagggtgggcacagctgccaggggctggagctggcccgggaacttgttctggccaaggtgagggccctgttcttggatgccttggggccccccgcggtgaccagggaaggtggggaccctggagtcaggcggctgccccgaagacatgccctggggggcttcacacacaggggctctgagcccgaggaagaggaggatgtctcccaagccatccttttcccagccacagatgccagctgtgaggacaagtcagctgccagagggctggcccaggaggctgaggagggcctcttcagatacatgttccggccatcccagcatacacgcagccgccaggtgacttcagcccagctgtggttccacaccgggctggacaggcagggcacagcagcctccaatagctctgagcccctgctaggcctgctggcactgtcaccgggaggacccgtggctgtgcccatgtctttgggccatgctccccctcactgggccgtgctgcacctggccacctctgctctctctctgctgacccaccccgtcctggtgctgctgctgcgctgtcccctctgtacctgctcagcccggcctgaggccacgcccttcctggtggcccacactcggaccagaccacccagtggaggggagagagcccgacgctcaactcccctgatgtcctggccttggtctccctctgctctgcgcctgctgcagaggcctccggaggaaccggctgcccatgccaactgccacagagtagcactgaacatctccttccaggagctgggctgggaacggtggatcgtgtaccctcccagtttcatcttccactactgtcatggtggttgtgggctgcacatcccaccaaacctgtcccttccagtccctggggctccccctaccccagcccagccctactccttgctgccaggggcccagccctgctgtgctgctctcccagggaccatgaggcccctacatgtccgcaccacctcggatggaggttactctttcaagtatgagacagtgcccaaccttctcacgcagcactgtgcttgtatctaagggtggggggtcttccttcttaatcccatggctggtggccacgcccccaccatcatcagctgggaggaaaggcagagttgggaaatagatggctcccactcctccctcctttcacttctctgcctatgggctaccctccccaccccacttctatctcaataaagaacacagtgcatatgacttgaaaaaaaaaaaaaaaaaaaaaaaaaacaaaaaagacaagacaacagacgaaaacaagagagggaggcggcgcgcgctcacgaagagaatattctctccgacgagggggaccccaagcgatcagcgagcacgcaccacccgaagcataatggaggatacacagagggtggccccaccatataggggaggagccagagaatataacagagagggaagccacgagcgagcgcggtaggatacgaacgacagacaacgcgccgccacgagacgccgggcggacgacacaccacgcgagcagaaacgcacgggggcgcacacctcagctgggagaggagagggcagccccacacaacccatcgcacaggcagggaggggaacgacacaccccgctggcggcaacgaccacctccacacaaacgagagcgattatacagacggccccggatggggggggaatacatccatgcaaacccctctgtcgacacggcgtgtctatacaaagcgggtgtagtaaccacccccaccgccagtacctacgacactccggcagagtctatatgagcaaggttttgcgcccgtccaagctgcaaccagtcaactagcccacaggaaatactatttttaccaccacggggggccatctaccaaacaaa

SEQ ID NO: 66005 - DNA, 1334 bp, Homo sapiens
gaaggactggggaagactggatgagaagggtagaagagggtgggtgtgggatggggaggggagagtggaaaggccctgggcagaccctggcagaaggggcacggggcagggtgtgagttccccactagcagggccaggtgagctatggtgctgcacctactgctcttcttgctgctgaccccacagggtgggcacagctgccaggggctggagctggcccgggaacttgttctggccaaggtgagggccctgttcttggatgccttggggccccccgcggtgaccagggaaggtggggaccctggagtcaggcggctgccccgaagacatgccctggggggcttcacacacaggggctctgagcccgaggaagaggaggatgtctcccaagccatccttttcccagccacagatgccagctgtgaggacaagtcagctgccagagggctggcccaggaggctgaggagggcctcttcagatacatgttccggccatcccagcatacacgcagccgccaggtgacttcagcccagctgtggttccacaccgggctggacaggcagggcacagcagcctccaatagctctgagcccctgctaggcctgctggcactgtcaccgggaggacccgtggctgtgcccatgtctttgggccatgctccccctcactgggccgtgctgcacctggccacctctgctctctctctgctgacccaccccgtcctggtgctgctgctgcgctgtcccctctgtacctgctcagcccggcctgaggccacgcccttcctggtggcccacactcggaccagaccacccagtggaggggagagagcccgacgctcaactcccctgatgtcctggccttggtctccctctgctctgcgcctgctgcagaggcctccggaggaaccggctgcccatgccaactgccacagagtagcactgaacatctccttccaggagctgggctgggaacggtggatcgtgtaccctcccagtttcatcttccactactgtcatggtggttgtgggctgcacatcccaccaaacctgtcccttccagtccctggggctccccctaccccagcccagccctactccttgctgccaggggcccagccctgctgtgctgctctcccagggaccatgaggcccctacatgtccgcaccacctcggatggaggttactctttcaagtatgagacagtgcccaaccttctcacgcagcactgtgcttgtatctaagggtggggggtcttccttcttaatcccatggctggtggcctccccaccccacttctatctcaataaagaacacagtgcatatgacttga

SEQ ID NO: 66006 - DNA, 530 bp, Homo sapiens
tctataatagtgatttcagttctgtagagaaacaaatattatctttcatagtgtttaagccttgatagcatctgtccctcttgctgcacaggagatgtgaattatgttgtctatgcactgatgaattaaaattgcctcaggcattgtcaactgtgatgacatttgatacggtttggatctgtgtccccacccaaatttcatgtggaattgtaatccccaatgttggagatgggggtctggcgggagctgactagctcatgagggtggatccttcatgaatggtttagcaccatccccttggtggtgttcttgtgatagagttctcatgcgatctggttgtttaagtgtgtagcactgcaccgccctctttcttgcttccactccagccacgtgatgcacctactcccccttccgccatgattataagtttcctgagacctcctctgaagtggaacagatgtcagcatgatgcttcctgtacaccctgtggaataatgagccaattaaatctcttttctttataaattacc

SEQ ID NO: 66007 - DNA, 2874 bp, Homo sapiens
  misc_feature (1)..(1): n is a, c, g, or t
  misc_feature (4)..(4): n is a, c, g, or t
  misc_feature (2868)..(2868): n is a, c, g, or t
  misc_feature (2871)..(2871): n is a, c, g, or t
  misc_feature (2874)..(2874): n is a, c, g, or t
naantccggagctgaaaaaggatcctgactgaaagctagaggcattgaggagcctgaagattctcaggttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcttgatactccagatccctatgtggaactttttatctctacaacccctgacagcaggaagagaacaagacatttcaataatgacataaaccctgtgtggaatgagacctttgaatttattttggatcctaatcaggaaaatgttttggagattacgttaatggatgccaattatgtcatggatgaaactctagggacagcaacatttactgtatcttctatgaaggtgggagaaaagaaagaagttccttttattttcaaccaagtcactgaaatggttctagaaatgtctcttgaagtttgctcatgcccagacctacgatttagtatggctctgtgtgatcaggagaagactttcagacaacagagaaaagaacacataagggagagcatgaagaaactcttgggtccaaagaatagtgaaggattgcattctgcacgtgatgtgcctgtggtagccatattgggttcaggtgggggtttccgagccatggtgggattctctggtgtgatgaaggcattatacgaatcaggaattctggattgtgctacctacgttgctggtctttctggctccacctggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgatatctttgggatgttaataggagaaacactaattcataatagaatgaatactactctgagcagtttgaaggaaaaagttaatactgcacaatgccctttacctcttttcacctgtcttcatgtcaaacctgacgtttcagagctgatgtttgcagattgggttgaatttagtccatacgaaattggcatggctaaatatggtacttttatggctcccgacttatttggaagcaaattttttatgggaacagtcgttaagaagtatgaagaaaaccccttgcatttcttaatgggtgtctggggcagtgccttttccatattgttcaacagagttttgggcgtttctggttcacaaagcagaggctccacaatggaggaagaattagaaaatattaccacaaagcatattgtgagtaatgatagctcggacagtgatgatgaatcacacgaacccaaaggcactgaaaatgaagatgctggaagtgactatcaaagtgataatcaagcaagttggattcatcgtatgataatggccttggtgagtgattcagctttattcaataccagagaaggacgtgctgggaaggtacacaacttcatgctgggcttgaatctcaatacatcttatccactgtctcctttgagtgactttgccacacaggactcctttgatgatgatgaactggatgcagctgtagcagatcctgatgaatttgagcgaatatatgagcctctggatgtcaaaagtaaaaagattcatgtagtggacagtgggctcacatttaacctgccgtatcccttgatactgagacctcagagaggggttgatctcataatctcctttgacttttctgcaaggccaagtgactctagtcctccgttcaaggaacttctacttgcagaaaagtgggctaaaatgaacaagctcccctttccaaagattgatccttatgtgtttgatcgggaagggctgaaggagtgctatgtctttaaacccaagaatcctgatatggagaaagattgcccaaccatcatccactttgttctggccaacatcaacttcagaaagtacaaggctccaggtgttccaagggaaactgaggaagagaaagaaatcgctgactttgatatttttgatgacccagaatcaccattttcaaccttcaattttcaatatccaaatcaagcattcaaaagactacatgatcttatgcacttcaatactctgaacaacattgatgtgataaaagaagccatggttgaaagcattgaatatagaagacagaatccatctcgttgctctgtttcccttagtaatgttgaggcaagaagatttttcaacaaggagtttctaagtaaacccaaagcatagttcatgtactggaaatggcagcagtttctgatgctgaggcagtttgcaatcccatgacaactggatttaaaagtacagtacagatagtcgtactgatcatgagagactggctgatactcaaagttgcagttacttagctgcatgagaataatactattataagttaggttgacaaatgatgttgattatgtaaggatatacttagctacattttcagtcagtatgaacttcctgatacaaatgtagggatatatactgtatttttaaacatttctcaccaactttcttatgtgtgttctttttaaaaattttttttcttttaaaatatttaacagttcaatctcaataagacctcgcattatgtatgaatgttattcactgactagatttattcataccatgagacaacactatttttatttatatatgcatatatatacatacatgaaataaatacatcaatataaaaataaaaaaaaacnganttn

SEQ ID NO: 66008 - DNA, 302 bp, Homo sapiens
gtatttttagtagagatggtgtttcaccttgttggccaggatggtctcaatctcttgacctcatgatccgcccgccttggcctcccaaagtgctaggattacaggcgtgagccaccgtgcccagcccaaagatccctttttaaacatgtattttggagtctgtatggtgaccttttatttttccctaggcactgaaaatgaagatgctggaagtgactatcaaagtgataatcaagcaagttggattcatcgtatgataatggccttggtgagtgattcagctttattcaataccagagaag

SEQ ID NO: 66009 - DNA, 2868 bp, Homo sapiens
  misc_feature (8)..(8): n is a, c, g, or t
  misc_feature (17)..(17): n is a, c, g, or t
  misc_feature (22)..(22): n is a, c, g, or t
  misc_feature (2862)..(2862): n is a, c, g, or t
  misc_feature (2865)..(2865): n is a, c, g, or t
  misc_feature (2868)..(2868): n is a, c, g, or t
aaagaagnaaaataaantaaanaaattaattttatattaaaaaaaaaaaaaaaaaaacttagttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcttgatactccagatccctatgtggaactttttatctctacaacccctgacagcaggaagagaacaagacatttcaataatgacataaaccctgtgtggaatgagacctttgaatttattttggatcctaatcaggaaaatgttttggagattacgttaatggatgccaattatgtcatggatgaaactctagggacagcaacatttactgtatcttctatgaaggtgggagaaaagaaagaagttccttttattttcaaccaagtcactgaaatggttctagaaatgtctcttgaagtttgctcatgcccagacctacgatttagtatggctctgtgtgatcaggagaagactttcagacaacagagaaaagaacacataagggagagcatgaagaaactcttgggtccaaagaatagtgaaggattgcattctgcacgtgatgtgcctgtggtagccatattgggttcaggtgggggtttccgagccatggtgggattctctggtgtgatgaaggcattatacgaatcaggaattctggattgtgctacctacgttgctggtctttctggctccacctggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgatatctttgggatgttaataggagaaacactaattcataatagaatgaatactactctgagcagtttgaaggaaaaagttaatactgcacaatgccctttacctcttttcacctgtcttcatgtcaaacctgacgtttcagagctgatgtttgcagattgggttgaatttagtccatacgaaattggcatggctaaatatggtacttttatggctcccgacttatttggaagcaaattttttatgggaacagtcgttaagaagtatgaagaaaaccccttgcatttcttaatgggtgtctggggcagtgccttttccatattgttcaacagagttttgggcgtttctggttcacaaagcagaggctccacaatggaggaagaattagaaaatattaccacaaagcatattgtgagtaatgatagctcggacagtgatgatgaatcacacgaacccaaaggcactgaaaatgaagatgctggaagtgactatcaaagtgataatcaagcaagttggattcatcgtatgataatggccttggtgagtgattcagctttattcaataccagagaaggacgtgctgggaaggtacacaacttcatgctgggcttgaatctcaatacatcttatccactgtctcctttgagtgactttgccacacaggactcctttgatgatgatgaactggatgcagctgtagcagatcctgatgaatttgagcgaatatatgagcctctggatgtcaaaagtaaaaagattcatgtagtggacagtgggctcacatttaacctgccgtatcccttgatactgagacctcagagaggggttgatctcataatctcctttgacttttctgcaaggccaagtgactctagtcctccgttcaaggaacttctacttgcagaaaagtgggctaaaatgaacaagctcccctttccaaagattgatccttatgtgtttgatcgggaagggctgaaggagtgctatgtctttaaacccaagaatcctgatatggagaaagattgcccaaccatcatccactttgttctggccaacatcaacttcagaaagtacaaggctccaggtgttccaagggaaactgaggaagagaaagaaatcgctgactttgatatttttgatgacccagaatcaccattttcaaccttcaattttcaatatccaaatcaagcattcaaaagactacatgatcttatgcacttcaatactctgaacaacattgatgtgataaaagaagccatggttgaaagcattgaatatagaagacagaatccatctcgttgctctgtttcccttagtaatgttgaggcaagaagatttttcaacaaggagtttctaagtaaacccaaagcatagttcatgtactggaaatggcagcagtttctgatgctgaggcagtttgcaatcccatgacaactggatttaaaagtacagtacagatagtcgtactgatcatgagagactggctgatactcaaagttgcagttacttagctgcatgagaataatactattataagttaggttgacaaatgatgttgattatgtaaggatatacttagctacattttcagtcagtatgaacttcctgatacaaatgtagggatatatactgtatttttaaacatttctcaccaactttcttatgtgtgttctttttaaaaattttttttcttttaaaatatttaacagttcaatctcaataagacctcgcattatgtatgaatgttattcactgactagatttattcataccatgagacaacactatttttatttatatatgcatatatatacatacatgaaataaatacatcaatataaaaataaaaaaaaacnganttn

SEQ ID NO: 66010 - DNA, 823 bp, Homo sapiens
  misc_feature (1)..(2): n is a, c, g, or t
  misc_feature (651)..(651): n is a, c, g, or t
  misc_feature (700)..(700): n is a, c, g, or t
nntggtttaagtttcttaacaatttttatgtttttttttcataccaaatcatttctatgccatgccagccaaaggctcattttttctcctttttttttttcatcctaactacagttttcccttctcatttttcttcccttcccttccctgtctcctattcctgcgattctgtcttgatgatgtctaggtgatagagggaaaaaagggaggagagtttaaaatcttttaaagtagatattctgtttttggaatctcccacgtgatttgggtaaagtggaggagtctttgggggcaagtcagctatcttgcatatgtatcttcctcattcggaatgcgtgttagataagtgcaggataatctggaggcaaataccaggcttcagaagcatccttctcttttctttcttttcccttgagacagagtctcactctgttgcccaggctgaagtgcagtggtgtgatcttggctcactgcaacctccacctcccaggttcaagtgattctcgtgcctcagcctcccaagtagctgggactacaggcgcgtaccaccacaccgggctaattttttgtgtttttagtagagatggggtttcaccaagttggccaggctggtctcgaactcctgacctcaggtgatccgcctgcctcggncacccaaagtgctgggattacagacgtgagccaccgtgcacggcctctnttcttttttatcaaatgctgaaatctgaatgcccagggagattggtggcccttgccaggaagtgtcttaacactttgtggatactgctgcctgttgtctttaaaagctgggactcatcaaatt

SEQ ID NO: 66011 - DNA, 525 bp, Homo sapiens
tacgataatcatgtatcacttcaaaaacaaagtatttttagaaaagaacgaatactactgaagttggtattgtgactttatattcttatattatctgttggtccacactgaatcctttctgccacttgcaggccatttactcagcctcagggtgtttttctggaggttgtctcactgattggacctacctagctctttagttagcattagctgaagtcactggtgttgtcctttgaggtgctttgtggagaaaaagcgttgtatggtcaataggttagagaactgtgaatgtgatacctcactttaagagatcaccaatcacacttgcacattcaagtatctgtgaaggtgctcctgaaaatgaacttgtcaacatttaatctaatacttctccaaattctttgagcatggagggagctattttcttgttttatcaactgctaacataccatggaactagtatctgcaaagcagattatgagagacatgagcttaaatggtgatctagtgctttgttatggattt

SEQ ID NO: 66012 - DNA, 1479 bp, Homo sapiens
  misc_feature (12)..(12): n is a, c, g, or t
gaaacagcccgnccggcaccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccccgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtccctctgggatttctttgtcatgtacagactccctgggatcctcatgttttgggtgacaggacctatggaccactatactcggggaggcagggtagcagttcttccagaatcccaagagcttctctgggattttcttgtgatatctgattccccagtgaggcctgggacgtttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctccaagatccttttgt

SEQ ID NO: 66013 - DNA, 1264 bp, Homo sapiens
  misc_feature (12)..(12): n is a, c, g, or t
gaaacagcccgnccggcaccaccatgctcgccctggaggctgcacagctcgacgggccacacttcagctgtctgtacccagatggcgtcttctatgacctggacagctgcaagcattccagctaccctgattcagagggggctcctgaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtccctctgggatttctttgtcatgtacagactccctgggatcctcatgttttgggtgacaggacctatggaccactatactcggggaggcagggtagcagttcttccagaatcccaagagcttctctgggattttcttgtgatatctgattccccagtgaggcctgggacgtttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctccaagatccttttgt

SEQ ID NO: 66014 - DNA, 1532 bp, Homo sapiens
  misc_feature (12)..(12): n is a, c, g, or t
gaaacagcccgnccggcaccaccatgctcgccctggaggctgcacaattcaggtggctggaggcagcctcagcatgcccctgtgtctctccccctccaggctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccccgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtccctctgggatttctttgtcatgtacagactccctgggatcctcatgttttgggtgacaggacctatggaccactatactcggggaggcagggtagcagttcttccagaatcccaagagcttctctgggattttcttgtgatatctgattccccagtgaggcctgggacgtttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctccaagatccttttgt

SEQ ID NO: 66015 - DNA, 512 bp, Homo sapiens
cacttggatggcctgggggcagggttgctcttctgggggagggtcattcattcagttggcttttggctttcctttctccgggctgggcctggttctcttttgaacacttgtcgtgctgcagcaagagcatctttggatttggggctgtggagctgtggttcacccgcgggagtcacagccgcggcctggacctttccacctcgcaccctcgctcaccctccttcatgatgcctggaggatgcctgagacaattgccttgaagatgaggaaagtgtttcactgtttattttctccatgggatgtagcaggcaagcatgcttaggacagaaaaccactgagtttactcaggtaaatgcgggcctaatacaagagtattgggttccaatgttggttaaccaatgcagttaatacgcaatgcttctattttttttctttttgtaatcttatttagaagtttcaaacaaaaagacatagtctgctgatcaataaacatggagctgccctctcccact

SEQ ID NO: 66016 - DNA, 349 bp, Homo sapiens
aaactagctctcacatgcattgtagcctgcattccattcatccgagtaacccagaaaaatctcataccctgaaattaaattcagttgatttcagatagctagtagccccagacacctgaggataaaagtacaagtattctttggaggaatacaacaatatcctgggcttcaaactatttatttaaaataaaatctaatgtctacgtcatgcaatgcatgtttgtgcaaaacctggcgctaaagcatttgtagatgacctgcttctgtgtgagggtttcatccacagcggggcagttctctcactgtgatctatggagagtcagcctttgacacaagggtttgtaagaaa

SEQ ID NO: 66017 - DNA, 596 bp, Homo sapiens
ggtataatgaggcatgtctgacccctgcccccttcccatcatgacctgaactagtttttcaggttagctttggaatgcccttgctgagaggaggggtcccttcagatgatcaggggatttagaattttatttttggttaacagagtacattttctagccatttcctgaaaccattctcagcttctacccagggtgtatcagtcaggactcatttgtttgcaagaaacataacacaaactggctccaacaaaaaagggaaggaattgcctcaaatcagaaaagtccaagtggtaactataggcatgtctggacccagtaattctaaaagtattgtcagatacttcttcccaccaccttcccccttcacacccctgcttcccatttctgtggtaggctacacactcagtaggcctcatctacgtggcagaacttggaaatgccaggcaaacactacagttgaataattctagtagaaagagaatgcttcttccctaattggtttcagcagaagtctggcttagggtcatatcagctgactcccagtttgtaacccactttacattagctttcagagttcaattatacttcagatacag

SEQ ID NO: 66018 - DNA, 525 bp, Homo sapiens
tttaaaaaagagagacatttaatagtgtttttccaagtttttgtctgcggactgttttatctgtcttactgtttcccttggtcatccattcatccaaccatttatttgtctgtctactttcaactattagataatacatgtatgtggcacaaaacacaaaagatactgaaaaatacataaatgaaaagtcttcctcctatcttatccctggccactcagtttattttcccaaagacaagcactaatacccagtgcataatttcagagatactcgatcaatagacaaacatatatacacatgtttacggtctaattttattttaacacaacagaagtatgctttatactcgtctgcacctagtttttttaacttctattaatgcccatattgggctgtctcattctttcagatggatatagagattccactgcatgaatgtaactttatttaagcagactccttacgaatgctcatttaaaatgctacaatgctgcaatgagtatacttatctatatatcattctg

SEQ ID NO: 66019 - DNA, 2041 bp, Homo sapiens
cctttgtcattctagctgcctgctgcctccgcagcgtccccccagctctccctgtgctaactgcctgcaccttggacagagcgggtgcgcaaatcagaaggattagttgggacctgccttggcgaccccatggcatcccccagaaccgtaactattgtggccctctcagtggccctgggactcttctttgttttcatggggactatcaagctgacccccaggctcagcaaggatgcctacagtgagatgaaacgtgcttacaagagctatgttcgagccctccctctgctgaagaaaatggggatcaattccattctcctccgaaaaagcattggtgcccttgaagtggcctgtggcatcgtcatgacccttgtgcctgggcgtcccaaagatgtggccaacttcttcctactgttgctggtgttggctgtgctcttcttccaccagctggtcggtgatcctctcaaacgctacgcccatgctctggtgtttggaatcctgctcacttgccgcctgctgattgctcgcaagcccgaagaccggtcttctgagaagaagcctttgccagggaatgctgaggagcaaccctccttatatgagaaggcccctcagggcaaagtgaaggtgtcatagaaaagtggaagtgcaaagagtggaccttccaggcagttgcgtccatgacaccaggaagatgtcagtgtgtgtttttcatttgatttatttatcttggggaaagtgaaaaatgtaatctgcaagttaatgaccctattggcttgtgtacatctatatgctaaaatgacttccccacattgacatttgtgcgccacctttaatcactctggggcaactctcacatcttgctgcatgtacatgtatacggctactattgaagtgtaattgtgagatggactccaacaagcatgtgactgtgagattgtgtgtgggaaaatgtatttaactactctgtgtgtgtgtgtgtgtgtgtgtgcgcacgcgcgcacgcgcacacactcacgcacacacaagcagagaaggcgctgatcttgaactaatcctgcacaggcatccttccctttatagattgattccagcaaaggcggaataaaacaaatttcctatgaagagaatcctgatatgaaacaagtcatgtagtctcatggccgggaatctctccacagatactaacaacttaaacttactactttaggagaaaaaaaaaaacattcaatttcggacactgagttatatatgaaattaattaggctctagtccaacagttgtttacattttaaatagtccatattgaatttaattaaaacaagggatgcatgcagtcaaattgatagtttaattcttcaagtgataatataggaagtttcaccttgcctttgtccaagccccacctattaaaaccctttactcacagtttgaaactgaagcagtaaacttgtttccagacatctttttcagattgtcttaagcccaaagttgcctcacttccactattctcagcagccaaccaggatttggcagctgctccactgttacggttgagggaacagggatcagtcctgttagaagtctgtgagcctcaaactctacctgttctctgcaatcatccaaaatttgaaaaagaagctatatccagtgtttcactgccaaacagattcactactcttactgattcttcactgagctttgctagtataagcagagttccaagtctcccctagggttgtctctacatttctttatcattccagtgggtagggtttagctgggggaaggacatttcataagggttagttggactgagcagtatggacatttgcttttttcattacgtactgttgtttttccttgttaggtgtgctttggtggttttaatattattgtgccagggatggggaaatggggggggttgtgtgggaagagtacttattattgtgttttcttcagtgtaattgttcttggtaattgatacctctctgttttatttctctcattctttcaaaataaaactttttgaaatttggaggaa

SEQ ID NO: 66020 - DNA, 2171 bp, Homo sapiens
ttcagatttctctgtttggctcttgattatgcagttcaggagccatttcttgcctcttagagggactctctaagaagcccctgtctctcagaggcagagtctctcagaaccccaaccctagatcagctgggatgattatctgggattttttgttttccattaaggagtggattcctctgcatcgaggaggttagtcatgtattgactgcagtggcatttcttataagatctcaaagcgttgttgctgctgttgttgttttaagattatttgttctttagaacatgtctgtgaggtagatttagtgtattcgttatttttattttactgatggataaactaaagcagaacaagtttaatgacatatccaaggccagaaagaaacgtgcttacaagagctatgttcgagccctccctctgctgaagaaaatggggatcaattccattctcctccgaaaaagcattggtgcccttgaagtggcctgtggcatcgtcatgacccttgtgcctgggcgtcccaaagatgtggccaacttcttcctactgttgctggtgttggctgtgctcttcttccaccagctggtcggtgatcctctcaaacgctacgcccatgctctggtgtttggaatcctgctcacttgccgcctgctgattgctcgcaagcccgaagaccggtcttctgagaagaagcctttgccagggaatgctgaggagcaaccctccttatatgagaaggcccctcagggcaaagtgaaggtgtcatagaaaagtggaagtgcaaagagtggaccttccaggcagttgcgtccatgacaccaggaagatgtcagtgtgtgtttttcatttgatttatttatcttggggaaagtgaaaaatgtaatctgcaagttaatgaccctattggcttgtgtacatctatatgctaaaatgacttccccacattgacatttgtgcgccacctttaatcactctggggcaactctcacatcttgctgcatgtacatgtatacggctactattgaagtgtaattgtgagatggactccaacaagcatgtgactgtgagattgtgtgtgggaaaatgtatttaactactctgtgtgtgtgtgtgtgtgtgtgtgcgcacgcgcgcacgcgcacacactcacgcacacacaagcagagaaggcgctgatcttgaactaatcctgcacaggcatccttccctttatagattgattccagcaaaggcggaataaaacaaatttcctatgaagagaatcctgatatgaaacaagtcatgtagtctcatggccgggaatctctccacagatactaacaacttaaacttactactttaggagaaaaaaaaaaacattcaatttcggacactgagttatatatgaaattaattaggctctagtccaacagttgtttacattttaaatagtccatattgaatttaattaaaacaagggatgcatgcagtcaaattgatagtttaattcttcaagtgataatataggaagtttcaccttgcctttgtccaagccccacctattaaaaccctttactcacagtttgaaactgaagcagtaaacttgtttccagacatctttttcagattgtcttaagcccaaagttgcctcacttccactattctcagcagccaaccaggatttggcagctgctccactgttacggttgagggaacagggatcagtcctgttagaagtctgtgagcctcaaactctacctgttctctgcaatcatccaaaatttgaaaaagaagctatatccagtgtttcactgccaaacagattcactactcttactgattcttcactgagctttgctagtataagcagagttccaagtctcccctagggttgtctctacatttctttatcattccagtgggtagggtttagctgggggaaggacatttcataagggttagttggactgagcagtatggacatttgcttttttcattacgtactgttgtttttccttgttaggtgtgctttggtggttttaatattattgtgccagggatggggaaatggggggggttgtgtgggaagagtacttattattgtgttttcttcagtgtaattgttcttggtaattgatacctctctgttttatttctctcattctttcaaaataaaactttttgaaatttggaggaa

SEQ ID NO: 66021 - DNA, 2577 bp, Homo sapiens
gttccattgacactggttgctacagaattaactttactcggagatccgaggagccatcggcagttcccaggagtaagaacctgagagcgtgtgagaatttgagagggaagatctgatctcctagaattagagttggtacagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcaggtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcacttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatggaaaaataaaaaaaattaaaaagtaaatttttgcttttcattatattgaaa

SEQ ID NO: 66022 - DNA, 3047 bp, Homo sapiens
cgggtccacagatgaggggagtcgagactcccgcgccccaccacccccggcggagctgctgctgagccactcaatctgagccctggctactaataaagttcgtttaaaaatcataatcattcttaagagagcgaaagagggtgcgaactagccgctcggccccgcagggagagctggcgcgtcgggaggagacagcggcggcagcggttgcgccgcgaccaggaggagccggtggcgccgggcggcgggtccgcggccggtgggggacggtgagtagcggctcgcgctgcggtgcagcggcgctgcactcactcgccctctccaggggctgggggttcgtccggctccactggggaagactcagcttctccccggggtcccgggttgtgccttactctccggagtgggcaggggtatcgagggcaggggcctcccggcccggctcccccatcccccggttcggaccgccgagcgccggctctcccctccctgagcaccgatcccaagttccagctagagaaggtgggcggcagcgccagcccggcgccccctcccagctcccagcgatttgagagggaagatctgatctcctagaattagagttggtacagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcaggtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcacttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatggaaaaataaaaaaaattaaaaagtaaatttttgcttttcattatattgaaa

SEQ ID NO: 66023 - DNA, 1311 bp, Homo sapiens
cgggtccacagatgaggggagtcgagactcccgcgccccaccacccccggcggagctgctgctgagccactcaatctgagccctggctactaataaagttcgtttaaaaatcataatcattcttaagagagcgaaagagggtgcgaactagccgctcggccccgcagggagagctggcgcgtcgggaggagacagcggcggcagcggttgcgccgcgaccaggaggagccggtggcgccgggcggcgggtccgcggccggtgggggacggtgagtagcggctcgcgctgcggtgcagcggcgctgcactcactcgccctctccaggggctgggggttcgtccggctccactggggaagactcagcttctccccggggtcccgggttgtgccttactctccggagtgggcaggggtatcgagggcaggggcctcccggcccggctcccccatcccccggttcggaccgccgagcgccggctctcccctccctgagcaccgatcccaagttccagctagagaaggtgggcggcagcgccagcccggcgccccctcccagctcccagcgatttgagagggaagatctgatctcctagaattagagttggtacagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattgatttgagagggaagatctgatctcctagaattagagttggtacagaaaccatttcagctccaaaaatgttggaggaagatatggaagtcgccataaagatggtatc

SEQ ID NO: 66024 - DNA, 494 bp, Homo sapiens
gaattcaacataaatagagtttatatgttgaaaagtaaagaagagtagtacaaagatgagttcaacatttatttacataaaagttgttttgaatggataaaagttgcccccattcttcatgagattgttttcttaatgtaaatgtaatatgttaatgtaaataccttgattgattgattgattgattgtgaacttacaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaagtaagatggctacttttggggaaggagggacagtaattctataaagttaagacatcttaatttttgcatagttttacaggttctaggaaaaattctatactttcattttgaaggctttaatgacttaaatattttaat

SEQ ID NO: 66025 - DNA, 2529 bp, Homo sapiens
cgggtccacagatgaggggagtcgagactcccgcgccccaccacccccggcggagctgctgctgagccactcaatctgagccctggctactaataaaatttgagagggaagatctgatctcctagaattagagttggtacagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcaggtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcacttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatgga

SEQ ID NO: 66026 - DNA, 2528 bp, Homo sapiens
gttccattgacactggttgctacagaattaactttactcggagatccgaggagccatcggcagttcccaggagtaagaacctgagagcgtgtgagaatttgagagggaagatctgatctcctagaattagagttggtacagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcaggtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcacttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatgga

SEQ ID NO: 66027 - DNA, 821 bp, Homo sapiens
ggggaacagtagtgtctggagggaagggggaagaatcttcatccactccattgtctgaattgttcacccggtaacttttgccatgacaattttacaaattaaggttttcttttaaaattgaggaataattgacatttcatcaagggcacagatcttcagcatggagcgtagacccaagggaccaccacaaagctcaagatgtaggacatctccatcaattcaggaggctccctccgggttacccccactccagagggtctcattttgttgctgaggctggagtgcggtggcacaaacgtggctcactgcaggcttgacgttctgggctcaagtgatcctcccatcttggcctcccgagtagctgggaccacaggccatgatactgctggtggtgcagaacggagtttagacaaggaggtgcacggccgagagcaatctggaaacgatcagagaggccagttgcgtaatgatggagaagccgctgttttgcagccacgaaaatcatgcctggagagagaatgttccgggatgtgaaattattcacaatctattgttcaaagaagacagttgattatgggacggaagagctccaggagaagagagctaagccagcccttgggatgactacaagaggaccggaggagacagggaaacacaaggggagtagaaggcttcagtagaagatttcagtagaggctgaaatctactgatatgtacacctccaaggacacatgtgtcacatcagaatagttgctgaatcccactgggcctctatttcctcatgtgtaaaatgggaataataaagctcctacttcacaggg

SEQ ID NO: 66028 - DNA, 537 bp, Homo sapiens
tctgctgacaacagcccacaaccatctagaaaacatgatttctacaaagtcttgatcctggaatggagcacacagccccttctccccaggccatgatactgctggtggtgcagaacggagtttagacaaggaggtgcacggccgagagcaatctggaaacgatcagagaggccagttgcgtaatgatggagaagccgctgttttgcagccacgaaaatcatgcctggagagagaatgttccgggatgtgaaattattcacaatctattgttcaaagaagacagttgattatgggacggaagagctccaggagaagagagctaagccagcccttgggatgactacaagaggaccggaggagacagggaaacacaaggggagtagaaggcttcagtagaagatttcagtagaggctgaaatctactgatatgtacacctccaaggacacatgtgtcacatcagaatagttgctgaatcccactgggcctctatttcctcatgtgtaaaatgggaataataaagctcctacttcacaggg

SEQ ID NO: 66029 - DNA, 840 bp, Homo sapiens
ggggaacagtagtgtctggagggaagggggaagaatcttcatccactccattgtctgaattgttcacccggtaacttttgccatgacaattttacaaattaaggttttcttttaaaattgaggaataattgacatttcatcaagggcacagatcttcagcatggagcgtagacccaagggaccaccacaaagctcaagatgtaggacatctccatcaattcaggaggctccctccgggttacccccactccagagggtctcattttgttgctgaggctggagtgcggtggcacaaacgtggctcactgcaggcttgacgttctgggctcaagtgatcctcccatcttggcctcccgagtagctgggaccacaggccatgatactgctggtggtgcagaacggagtttagacaaggaggtgcacggccgagagcaatctggaaacgatcagagaggccagttgcgtaatgatggagaagccgctgttttgcagccacgaaaatcatgcctggagagagaatgttccgggatgtgaaattattcacaatctattgttcaaagaagacagttgattatgggacggaagggatgctatggccttccagagctccaggagaagagagctaagccagcccttgggatgactacaagaggaccggaggagacagggaaacacaaggggagtagaaggcttcagtagaagatttcagtagaggctgaaatctactgatatgtacacctccaaggacacatgtgtcacatcagaatagttgctgaatcccactgggcctctatttcctcatgtgtaaaatgggaataataaagctcctacttcacaggg

SEQ ID NO: 66030 - DNA, 758 bp, Homo sapiens
ggggaacagtagtgtctggagggaagggggaagaatcttcatccactccattgtctgaattgttcacccggtaacttttgccatgacaattttacaaattaaggttttcttttaaaattgaggaataattgacatttcatcaagggcacagatcttcagcatggagcgtagacccaagggaccaccacaaagctcaagatgtaggacatctccatcaattcaggaggctccctccgggttacccccactccagagggtctcattttgttgctgaggctggagtgcggtggcacaaacgtggctcactgcaggcttgacgttctgggctcaagtgatcctcccatcttggcctcccgagtagctgggaccacaggtacgtgccaccacactcagctaatttttcttttccttttttttttttttgtagagacaggatcttgccgtgttgtccaggctggacttgaattcctgagctcaagcaatcctcctgccttggcctcccaaagtgctgggattacaggcatgagccactgctcctggcttgtttcaaaattaaaaagaaaaacttacatgcagtaaaattaagttttcccttttttattatatgtgctgccaaagttagtgctaaaatttccccttttgagtgtacagttctgtgagtttggggaaatatatacagttgtgtaacccccaccacagttgtgatatagaacataatcatcctatcctcgatggattatttgggcctgttacaaact

SEQ ID NO: 66031 - DNA, 546 bp, Homo sapiens
  misc_feature (543)..(543): n is a, c, g, or t
attggtcacccagggtctggccctgtgctagcacccaactgtgaacaagacccagaatccacctgtgaggagggagtccaactctctacagtgtagcctgcctctgctttttagaccttatcgaaaggacatcaaggagcttttggaggacttaaacagggatcagattgtccctttagttgtggtgtggagaagtgatcagaggagtgaggcaggctgtcaggcggccctgctggcctcggtgatacaggtgtcaggcagtggcggccttcgccggagtggtggtcatggagatggattctccagctgttcaggcagtggaattagcagtacctggcagctggctgaggaatttggcaacgccctgtccacacacttttgcttctaggacttctgtatgtctgttacacccactatactgcaaactcctcaagaatgccttgcaagcagagctgtctaattcatctgtgcatcgccagagcccagcaccgtgctgagcacatagtaggagctcaataaatgttagttgcatacgtgaaaaanaaa

SEQ ID NO: 66032 - DNA, 506 bp, Homo sapiens
tgttttcatctactgacttctatatacattctacaatatagttttattctttgtgtagatctactttccatctggtatcttttactatcatttgaagaatttcctttatttctgatagcaaaggtctgctggcaacaaattttgttgatctgaaaaattttaattttgctttatttattcttatttttgtagagatggggtttccctatgttgcctaggctggtctcaaactgctggcctcaagccatcctcctgccctgacctcccaaagttgctttcttttttgaaagccatattttctagataaagaattacaggttgacagttattttcccccaaccttttaatgaagtcattcaattgtcttttggcttgcattgttctagcctagaaacctgtgaattctttgttctttcacctgcattgtatcttcatttttctccttatcactggatttcaggaacttgactatgttatgtcttggtatgaattcttttgtgtttatc

SEQ ID NO: 66033 - DNA, 399 bp, Homo sapiens
cctcgaggagcccagctcagtgtgggcagaaaaggactcccaggatgctaggatgctgcacccattaacttgtcatttacattaggtatatctcctaatgctatgattccactttttatccctactcctacattgttggttttgccaaggatgttcttagaagactccaaccctcttttatgtggggaggaggtgctaaagccccctagtgagttggtattgttttttttctcttttgatttggggggttttcatctttcatggagtggactggccttggagacttcgcctgttgaaaggagaacttaaaagactggagtgcataaggagcttggcaatggaccgccaagacattcatggttgtgcactcttgcctcagtacccataaatctaatgatt

SEQ ID NO: 66034 - DNA, 423 bp, Homo sapiens
ctctccatgatccagaacattcacaggtgtttcagagaccctcaccatctccccaaggagaaagctcttctcttgcctggaaattcacagaagaagagaaaaaggcagcctctcagagctgatttcttgaagactgaactcttctgggcatggtgcactcctcctgggtgggtgacacgccacagtctaggacaagcagggcctagtggaacgacagtgtcgtggcctcctaacttgtgtgctctcaggcaaattactgagccctgtctgcaagatgctaataactctgaagatctatattcctagtcctttacaaaattttattataaattgacaatttatatttgtgtttatttacaagggtacaaagtgatatattttatgaatacaatgtataataattaaacccagctaattaacata

SEQ ID NO: 66035 - DNA, 2423 bp, Homo sapiens
  misc_feature (306)..(306): n is a, c, g, or t
  misc_feature (866)..(866): n is a, c, g, or t
  misc_feature (1517)..(1517): n is a, c, g, or t
  misc_feature (1563)..(1563): n is a, c, g, or t
  misc_feature (1661)..(1661): n is a, c, g, or t
aaaaaattaaggctgatagaggtaaagcaactttcccaagatcaagtaatagagctggatttcaacctacacatcccctctctagagcccatgattagaatcactgtgttgcaggtctgtgtctacaatggtaacgttgtgacataaccgagcagtatcagtggtgtcctccctggaaaggcctggccatcccagtgatacgtttctgagttagaaggcatcttggacactccacaggttcttaacctgcctgcacattggaattacctggaaaactggaaaataaacttatacctgaatcccacnctcagaattttggatttgactgatctgggtggagtattgttggtgggaaaggcaggtatttaaaagttccctagttggttccaatatgattcaaagttgagaaccactgaccagccctctggactggcaacacttacgtccctaactgtcagcatcagcatcatctggaaatttgtcagaaatgcagactgccaggcttcacctcaggtgatttgtatgcacactacagtttgagagaatggcaggcagtgctcagctaacccctaagggattaggaggacttagggaaagtgggaagggaagaacagagggaattctgatgttttctcatgattaacagggcttatgggttttggggaggaaaatagtgctgttctacccatatcgtatcaagagtacatactatcaatgtgacttataactattgatgttaaccttgatcacctggctgagatagtgtgtgtcagatttctccactgtagcaaattacttttgtccctacccccttccgtactttggaaggaattcactatgcacattcctcacttaaggaatggggngacatgctccgacttcatggggtcaggggtactatcaatttaatttatttggaattcttctgtacaggagattcatttcttctccctcatttatttacttagtcatttatgtcagtatggactcgtagatgtttattatatactttgggttataatccaatactactatattttgctcaaattgttccagccttggccattgggaactctttcagttggatcctgggctcctttgacatattcctatcatagggaatatgagaataacatcgcaaaaaaaccagaaaaggaagaatggcacataaaggaactcgaagcaggtcttggtggctgaagcagagattaccaagagattattagatcaaccttttcatacagacgagaaatgcttctttctaggactaaggactgagcactggctacttcctctgtctgcctggttcatatcttccacccgaagtgataccttctcaataacggcctaccctggtttcctcgtttaaatcatgatctttcctctaaacttgcactctcagacttcaatatttgctccattttttcccctcaacatttgtaaccttctaatatgctaaatagtgtatttattttgtctttctttactgcacatccccaccctagaatgtaaattcnacgagcgcacagattttgtttttgttctgcattgtatcctccagcnctaacaacagtatctgacacttcaaagaggtgcttcacatttatttgctgagttaaaatgaattaatcaatttacaaaaatttgggttagtttatgcntactttatctagagtgggattgtgaaatatcagtcaaaagccttttcaggagtttaaatgagtgaagaacaagatcaggtttgattttagaaagaccatctggctgtgtgtatctagtggacccaggaatggggaggccgagggctgcactaaacgcagggtaaggccagtttggtgacaatgtcagcctgccctaagagagcagtggctgaagaagatagcatgcatttgaggtcttcttaggaagtagcatcagcaggggacagctcagggagtaaggaagagaggagtcattctaggtttctgttttaggcaaccagaaggatggaaagccatctgtaggcagtgctgaggtagaacagatatttggagggaaaaagttaagctgttttgaagtattaaaaattgcagactgatgtaacctggtggaaatgtagatttcacattcattaaacaatgacctattacccttctggcactatagtaagccccaacgagtaagtggtagtcattcaatgaagtacccactatgtgccagacatagtgtcagctccagtggggaatgagacaggtgtgtggattcatcctccttgcacttgcagaacttggagaaacagaaaaaatcatgtgagagcaatgggagtgagaaggagagagagagagagagagagagagacagacagagatagtacaagattactttcagctagggattcaggggaatgcagctttctggtaatgatagcatttacagtggagctt

SEQ ID NO: 66036 - DNA, 427 bp, Homo sapiens
cagggctccaagcaaaatcaccttgcctcctaatagaatgtcaaaaggataaacattaattggggaaaaaaaaagttttcaccccaaagcctttcaaaaacagactcaaagagaaggaagttggtccctagccactgtgttcagcacagacccacgctgggcttagtattagcaaaaccggccaccaaaatcttcagtctgtggttccctgcacctgcagctctgagccctctgcctgtcctcccctccccctcccacccaccttagccaaattctcaggttcctggggggtggggaggaggtgggtattgactccaaatcctactggggagaatatcctaatttaaagcatctctttttccctttttaattttatttttctttttctgtcttcaaccttaacacatgaatgatcttaaagttttga

SEQ ID NO: 66037 - DNA, 456 bp, Homo sapiens
attttacattcccaccagcagtatatgagcgtttcattttctctaaatcctcaccaacacttaatattattgttttgattatagctgtcctagtggatgtgaagtggtatcttattgtggttttgatttgcatttccctgatgactaatgatgttcgtcatctttttatgtgtttactggccatttgataatcttctttggaaaaacaccttttcagattctttacccatttgtgtgtctttggagtaatattcacatcttttgcctatttttacttgggttatttatcattttattattaagttgtaagtgttcttaatatattctagatacaagtcacttattgtatgtatgatttgcaaatattttcctttttcttgggttgtcttttcactttcttgatggtgtccttggaaatacaagttttaaattttgataaagtccagtttatttttt

SEQ ID NO: 66038 - DNA, 672 bp, Homo sapiens
ctcttaatccatctcctattgccccgtcctctgcaatctgggccaaggagtacagcacagcagtagcgatgccatgtgccttccaagacgatgtcataaaagactgtattatagttctccacctggttctcctggaacaatcactcttataacccagctaccatggtatgacaaggtccaggcagcccatggcgtgttctacatgaagagggccatttggagaggaaccaggaccccggccctggaccccaactgagctctggtcaacagccttttgagcagccatcttgaaagaggattctccagccccctgaacggtcccagctgacactgcatggaacccaaaccttccatgcctagccatgcccaagttgcctatttccgaactcaataactgttgttttgagccactgttttgaagaggtttgctacacagcaataaataactgatacacacgactataaaagattctggcttctgcttaaaaattctatgagaaagatgctgagaattttctatgtattaaactattaagatttataggaggccattgatttagactgagctcctgctctaggcttcaacagatccaaccaaaatagagtcactcatgctaaagttccacatcaccaaaccaaaactaagctatttatctgacctgagaaatcaag

SEQ ID NO: 66039 - DNA, 469 bp, Homo sapiens
gcaaggagtggcctgggtgcatgtgcccagcgcctctgtgtggggtcttctccttctaccatctcaggacccctgggtctctgcagacctgctttccacccaaggggaagagaaaagggctgagcagaggtgaaggaggtaactgaaatgcattttcaacaactatttatgtttctcaaggtgaatgagaaatcccctgtgggaggctgaaaaaatgccttccaaaggtatccattctctaatccccagaacctgtaactatgttaccttatatggcaaaagggcctttggatacatgactaaggaatgcagacagcctgtagatagaaagggaagaaaatggattctcctctagaacctccagaaggaatgagccctgctggcaccttgactttagcccactgaaatttatttcgaacttccagcctccaaaattctaaaagaataaatctgtgttttttaaagccac

SEQ ID NO: 66040 - DNA, 605 bp, Homo sapiens
gtctttgcccattgaagaaagtttttgtaaattttcagataacattgtatgcttttgttgtgtacaacatgatgtgaagtatatatactttgttgagtggttaacatgtacgtattatatatgtacatattctgtatacgtattttaaatattaaccccttgcagatatgtgtttttcaaatactgtctaccattcagtctgcttccttttcattctgttcatgtctttttttttttttttttgcacaggagttttcaaatttcaatggagtccaatatatgttatgtttgtttcctatgcttttggtattatacccaagaaattattgctaaatccagtgtcatgaaccttttttcatgttattttctaggagttttatagttttaagttgtacttttatgtctgatttatttcagtttgttttagtaaatggaggaaggtaagagttcaacttcattcttttgcatatagatatccagctttttgaaagtcatttgttgaaaagactccttaataagtttttgcgctcttgtcaaaaatctgagcataagtatgaggacttccgtctggcctctttattccactatatgtatgcatttgtgct

SEQ ID NO: 66041 - DNA, 375 bp, Homo sapiens
gtctttgcccattgaagaaagtttttgtaaattttcagataacattgtatgcttttgttgtgtacaacatgatgtgaagtatatatactttgttgagtggttaacatgtacgtattatatatgtacatattctgtatacgtattttaaatattaaccccttgcagatatgtgtttttcaaatactgtctaccattcagtctgcttccttttcattctgttcatgtctttttttttttttttttgcacaggagttttcaaatttcaatggagtccaatatatgttatgtttgtttcctatgcttttggtattatacccaagaaattattgctaaaaaaaaaaagtcgacgcggccgcgaatttagtagtagtagta

SEQ ID NO: 66042 - DNA, 2444 bp, Homo sapiens
  misc_feature (933)..(933): n is a, c, g, or t
  misc_feature (935)..(935): n is a, c, g, or t
  misc_feature (948)..(948): n is a, c, g, or t
  misc_feature (1305)..(1305): n is a, c, g, or t
  misc_feature (1307)..(1307): n is a, c, g, or t
  misc_feature (1356)..(1356): n is a, c, g, or t
  misc_feature (1361)..(1361): n is a, c, g, or t
  misc_feature (1386)..(1386): n is a, c, g, or t
  misc_feature (1422)..(1422): n is a, c, g, or t
  misc_feature (1438)..(1438): n is a, c, g, or t
  misc_feature (1463)..(1463): n is a, c, g, or t
  misc_feature (1492)..(1492): n is a, c, g, or t
  misc_feature (1519)..(1519): n is a, c, g, or t
  misc_feature (2270)..(2270): n is a, c, g, or t
agttaaagcagcgttcagagggaaatgtttagctgtaagcatctacctttaaaaataagaaagccagcagtggtggctcatgccaacatcccagtattttgggaggctgaagcgggaggatcccctgaggtcaggagttcaagaccagtctaaccaacatggcaaaagcccatcgctactaaaaatacaaaaattagccaggcatggtgatgcaggcctgtaatcccagctacttgggaggctggggcaggagaatcgcttgaacctgggagagggaggttgcagtgagccgagatagcaccactgcattccagcctgggtgacagagtgagactctatctcaaaaaaaatcaataaaaataaaaaataaaagtaagaaagatctcaaattagtcacctcactataccctctaaaggatctagaaaaagaagagctaaccccaacctagcagaataccagaaacaaagattagagtggaaataaataaaggaaattaagagaatagataaaattaaaagttttttttacagttcagcaaaattgacaaatttttagctagattgactaagaaacacaagaagactcaaatatccaaaatcagaaatgaaaatgaggccattactgtgactttacaacaattaaggttatcgtaagagaatactataaacatatgtacaccagcaaattgaataaccaaatgaaatggcaaatctctagaaacacaaacctaccaagactgaatcacaaagaaataaaaaatatgggtaaaccaaccaggtgcagtggctcgtgcctgtaatcccagcactttgggaggccaaggtaggcggatcacctgagatcaggagttcaagaccagcctggccaacatggtgaaaccccttctctactaaaaatacaaaaatgagctgggtgtggtggcaggcgcctgnantcacagcaactcnggaggctgaggcaggagaatcacttgaactgggaggcggaagttgcagtgagctgagatcgcaccattgtgctccagcctgggggacaagagtgagacttcgtctccaaaaaaaaaaaaaaaaagaaaaagaaaatatgggtaaacgtataactagtaagaagattaaattaccaataaaatcttcccaacacagaaatacccttgactggatggctccaccagtgaattctaccagacatttaaaggaaaaattagtgccaatcctttgcaaactctttcaaaaacttgaagaggaggaaatactttcttttttttgtttgttttgagacagagtctcgctctgtcgcccacgctngngtgcagtggcgcgatcttggctcactgcaagctctggctcccgggttcncgccnttctcctgcctcagcctcccgagtngctgggactacaggcgcccaccacaacgcccggctnattttttgtatttttngcggagacggggtttcactgtgttngccaggatgatctctatctcctgacctcntgatccgcctgccttggccttccaaantgctgggattacaggcatgagccacccggtgcccggccgagaaggaaacactaactcattctatgaggacagcattgccttgttactagggccagacaaagacagtacaagaaaacaactgaccaatattgcttatgaacattgattaaaaaattctcaagaagacactgcctgctgggtgtggtggctcacgcctgtaatcccagcactttgggaggccaaggtgggtggatcacgaggtcaggagtttgagaccagcctggtcaagatggtgaaactctgtctctactaaaaataaagaaaattagctaggcatggtggtgggtgcctgtaaccccagctgcttgggaggctgtggcaggggaatcgcttgaacacgggaggcggaggtggctgtgagccgacattgcgccactgcgctccagcctgggcaacagagtgagactccatctcaaaaaaaaaaaaagaaaaaagaaaaaaaagaaaacactgcccaactggctggccgcagtggctcaggcgggtaatcccagcactttgggaggccaaggcaggtggatcacttgagttcaggagttcaagaccagcctggggaacgtagtgaggccccacctctacctagaatacaaaaatcagctggttgtggtgttaccctcctgtggttccagctgcttgggaggctgaggtgggaggatcactggaaccaggaagttgaggctgcagtgagccgagattgcaccactgcataccngcctgcacgacagagtgagactccatctcaaaaaaaaataaataaataaaaataaaaaataaaagaaagatctcaaatcagtcacctaactatacactttaaaggacctacaaaaagaagaactaaacccaagctagcagaataggggaaacaaagattagagtggaaataaat

SEQ ID NO: 66043 - DNA, 323 bp, Homo sapiens
attttaaataaccattagcctctgagtgtagagtttagattgactaacacctgagagctaaactgtaaagagcaacttaagacacagcaaggctcaggccggcccacttctcctcatacagctccataggaggcacccatatcccttcttggtcattccacccaacttaggggattctggaacttccatactacctgattcaagataaaagcaaaggaagtaatagattgtaaggagagtataagaaactgaatttggaaaagtagcacctgagacctttactatgaggtgggcaagcagctttctttatatctttaaaacta

SEQ ID NO: 66044 - DNA, 322 bp, Homo sapiens
cagggttctttgttacagcagttgtcctacccttatacaacatagcacctatcccactctgcactgcaatgcatttgtaggtctctgtctcactggactgtgggctccttgggggaaggagttgtgtcttgttagtctcatctccagctcctaacacagtgcagttaaacaggaggaacacattaaataaatatcgatggaaggagggtcatgggaaggaacaaattcatggatagaaaatgtagcacagcaaaaactatgccctggaaacacaattagcctttgctctgaatcagctgagactctggatgagtcagttttg

SEQ ID NO: 66045 - DNA, 1277 bp, Homo sapiens
tgagaaaatttatgaatttgtgttgggccgcattcaaaactgtcctgggccacgagttggacaagcgtggtttagctattctaaagctatcccagtgccctcagctgaattctaggactagcaggagaattagctgtactggagccaagttttcattggtgaagaccaacaaatcagcagccagttcattggcataattatttctcttgagttgctgccacccccacctctgttccccagggctgaaccgttagggctcttctctgccaccgccttccagagccccaggctccagcgcattaaagtccaaccatttgcttctcctcaccctgccagctgcaaaggtcgcatcagcttagggagaaaatagcccctggagggggcctttatagtgcatactctgggtgtgcctgtgactggactcttgcctcactctcactgtgcctcattcttcatcctgtctaatgaagagatctccagctcacagtcttcatggattgtggtaaggatgaaatgagaagagtgatttaagaactgccaagtggccaggatacctgtagggtggcccagtctcaggctttgtcactcttgtcctgtgtggtatcatcagaaacctgaaaaaagctaacattaacaatggttccttaagattctttggccaggcacagtggcttatgcctataatcccaacactttgagaggctgaggcaggtggatcatttgaggtcaagagctcgagatcagcctggccaaatggtgaaaccccttctctactaaaatacaaaaaatttgctgggcatggtagcacacacctgtaatcccagttactcaggaggctgaggcatgagaatcatttgaacctgggaggcagaggttgcagtgagctgagattgtgccattgcactctagcctgggtgacagaacaagactgtgtctcttagaaaaaaaaaaaaaattctttgaccttttacatatttaaaaaacacattataggaccaggcatggtggctcacgcctgtaatcccagcactttgggaggccgaggagggcagatcacgaggtcaagagatcgagaccattctggctaacatggtgaaaccccatctctactaaaaatacaaaaaattagttgggcatggtggcgggtgcctgtagtcccagctactcaggaagctgaggcaggagaatggcgtgaacccaggaggcagagcttgcagtgagccgagatggtgccactgcactccagcctgggcgacagagtgagactctgtctcaaa

SEQ ID NO: 66046 - DNA, 1275 bp, Homo sapiens
ggaggaaatctacaagcaccaggaagtcaagatgcaagcaccagccttcagggacaagaaacagggggtctcagccaagaatcaaggtgcccatgacccagactatgagaatatcaccttggccttcaaaaatcaggaccatgcaaagggtggtcattcacgacccacgagccaagtcccagcccagtgcaggccgccctcagactccacccaggtcccctgctggttgtacagagccatcctgagcctgtacatcctcctggccctggcctttgtcctctgcatcatcctgtcagccttcatcatggtgaagaatgctgagatgtccaaggagctgctgggctttaaaagggagctttggaatgtctcaaactccgtacaagcatgcgaagagagacagaagagaggctgggattccgttcagcagagcatcaccatggtcaggagcaagattgatagattagagacgacattagcaggcataaaaaacattgacacaaaggtacagaaaatcttggaggtgctgcagaaaatgccacagtcctcacctcaataaatgagaggacattgtggcagccaaagccacaacttggaagatggggctgcacctgccaacgaagacgggaaatgacccccccccccagcctagtgtgaacctgcccctcgtcccacgtatagaaaaacctcgagtcatggtgaatgagtgtctcggagttgctcgtgtgtgtgtacacctgcgtgcgtgtgtgtgcgtgtgtgcgcgtgtgttcgtgtatgtgcgtgtgtgcgtgcgcgtgtgtgtgcattttgcaaagggtggacatttcagtgtatctcccagaaaggtgatgaatgaataggactgagagtcacagtgaatgtggcatgcatgcctgtgtcatgtgacatatgtgagtctcggcatgtcacggtgggtgggctgtgtctgagcacctccagcagatgtcactctgagtgtgggtgttggtgacatgcattgcacgggcctgtctccctgtttgtgtaaacatactagagtatactgcggcgtgttttctgtctacccatgtcatggtgggggagatttatctccgtacatgtgggtgtcgccatgtgtgccctgtcactatctgtggctgggtgaacggctgtgtcattatgagtgtgccgagttatgccaccctgtgtgctcagggcacatgcacacagacatttatctctgcactcacattttgtgacttatgaagataaataaagtcaagggaaaacagcgtc

SEQ ID NO: 66047 - DNA, 1201 bp, Homo sapiens
ggaggaaatctacaagcaccaggaagtcaagatgcaagcaccagccttcagggacaagaaacagggggtctcagccaagaatcaaggtgcccatgacccagactatgagaatatcaccttggccttcaaaaatcaggaccatgcaaagggtggtcattcacgacccacgagccaagtcccagcccagtgcaggccgccctcagactccacccaggtcccctgctggttgtacagagccatcctgagcctgtacatcctcctggccctggcctttgtcctctgcatcatcctgtcagccttcatcatggtgaagaatgctgagatgtccaaggagctgctgggctttaaaagggagctttggaatgtctcaaactccgtacaagcatgcgaagagagacagaagagaggctgggattccgttcagcagagcatcaccatggtcaggagcaagattgatagattagagacgacattagcaggcataaaaaacattgacacaaaggtacagaaaatcttggaggtgctgcagaaaatgccacagtcctcacctcaataaatgagaggacattgtggcagccaaagccacaacttggaagatggggctgcacctgccaacgaagacgggaaatgacccccccccccagcctagtgtgaacctgcccctcgtcccacgtatagaaaaacctcgagtcatggtgaatgagtgtctcggagttgctcgtgtgtgtgcattttgcaaagggtggacatttcagtgtatctcccagaaaggtgatgaatgaataggactgagagtcacagtgaatgtggcatgcatgcctgtgtcatgtgacatatgtgagtctcggcatgtcacggtgggtgggctgtgtctgagcacctccagcagatgtcactctgagtgtgggtgttggtgacatgcattgcacgggcctgtctccctgtttgtgtaaacatactagagtatactgcggcgtgttttctgtctacccatgtcatggtgggggagatttatctccgtacatgtgggtgtcgccatgtgtgccctgtcactatctgtggctgggtgaacggctgtgtcattatgagtgtgccgagttatgccaccctgtgtgctcagggcacatgcacacagacatttatctctgcactcacattttgtgacttatgaagataaataaagtcaagggaaaacagcgtc

SEQ ID NO: 66048 - DNA, 427 bp, Homo sapiens
ctcatgtctgtaatcctagcactttgggaggctgaggcgggaggattgcgtgagccctggaggtggagactggcctgggcaacatagggagactctgtctgtaaaaaataaaaataaaaaaagaaggagagttcagatgggagaggtaaggggtcaaaggtgggggccgggggctccttcccctccaagatgtgtggatgtgtgtgtggatgtgtgtgtggtgtgatcactcaaactctcacacacccgctccacttaaccaaaaagcagattttagcttctcactccttatctttcaccccctacaatttattgagtgcaaagggttgggtaaaacaagatcccggatccactctccacaccacagagctctgagcagatctccaacccctcccaggtgcccatgacccagactatgagaatatca

SEQ ID NO: 66049 - DNA, 1157 bp, Homo sapiens
ggaggaaatctacaagcaccaggaagtcaagatgcaagcaccagccttcagggacaagaaacagggggtctcagccaagaatcaaggtgcccatgacccagactatgagaatatcaccttggccttcaaaaatcaggaccatgcaaagggtggtcattcacgacccacgagccaagtcccagcccagtgcaggccgccctcagactccacccaggtcccctgctggttgtacagagccatcctgagcctgtacatcctcctggccctggcctttgtcctctgcatcatcctgtcagccttcatcatggtgaagaatgctgagatgtccaaggagctgctgggctttaaaagggagctttggaatgtctcaaactccgtacaagcatgcgaagagagacagaagagaggctgggattccgttcagcagagcatcaccatggtcaggagcaagattgatagattagagacgacattagcaggcataaaaaacattgacacaaaggtacagaaaatcttggaggtgctgcagaaaatgccaccacaacttggaagatggggctgcacctgccaacgaagacgggaaatgacccccccccccagcctagtgtgaacctgcccctcgtcccacgtatagaaaaacctcgagtcatggtgaatgagtgtctcggagttgctcgtgtgtgtgcattttgcaaagggtggacatttcagtgtatctcccagaaaggtgatgaatgaataggactgagagtcacagtgaatgtggcatgcatgcctgtgtcatgtgacatatgtgagtctcggcatgtcacggtgggtgggctgtgtctgagcacctccagcagatgtcactctgagtgtgggtgttggtgacatgcattgcacgggcctgtctccctgtttgtgtaaacatactagagtatactgcggcgtgttttctgtctacccatgtcatggtgggggagatttatctccgtacatgtgggtgtcgccatgtgtgccctgtcactatctgtggctgggtgaacggctgtgtcattatgagtgtgccgagttatgccaccctgtgtgctcagggcacatgcacacagacatttatctctgcactcacattttgtgacttatgaagataaataaagtcaagggaaaacagcgtc

SEQ ID NO: 66050 - DNA, 1233 bp, Homo sapiens
tgatgacaagctgcatgaccacagctgctgatggttttgagaggagcgaggtgtccatggtgttagagacagtgaggatggtttgagtggtggtgctggcccctcaaggtcactttgctgcctctttgctccagtcccagcccagtgcaggccgccctcagactccacccaggtcccctgctggttgtacagagccatcctgagcctgtacatcctcctggccctggcctttgtcctctgcatcatcctgtcagccttcatcatggtgaagaatgctgagatgtccaaggagctgctgggctttaaaagggagctttggaatgtctcaaactccgtacaagcatgcgaagagagacagaagagaggctgggattccgttcagcagagcatcaccatggtcaggagcaagattgatagattagagacgacattagcaggcataaaaaacattgacacaaaggtacagaaaatcttggaggtgctgcagaaaatgccacagtcctcacctcaataaatgagaggacattgtggcagccaaagccacaacttggaagatggggctgcacctgccaacgaagacgggaaatgacccccccccccagcctagtgtgaacctgcccctcgtcccacgtatagaaaaacctcgagtcatggtgaatgagtgtctcggagttgctcgtgtgtgtgtacacctgcgtgcgtgtgtgtgcgtgtgtgcgcgtgtgttcgtgtatgtgcgtgtgtgcgtgcgcgtgtgtgtgcattttgcaaagggtggacatttcagtgtatctcccagaaaggtgatgaatgaataggactgagagtcacagtgaatgtggcatgcatgcctgtgtcatgtgacatatgtgagtctcggcatgtcacggtgggtgggctgtgtctgagcacctccagcagatgtcactctgagtgtgggtgttggtgacatgcattgcacgggcctgtctccctgtttgtgtaaacatactagagtatactgcggcgtgttttctgtctacccatgtcatggtgggggagatttatctccgtacatgtgggtgtcgccatgtgtgccctgtcactatctgtggctgggtgaacggctgtgtcattatgagtgtgccgagttatgccaccctgtgtgctcagggcacatgcacacagacatttatctctgcactcacattttgtgacttatgaagataaataaagtcaagggaaaacagcgtc

SEQ ID NO: 66051 - DNA, 724 bp, Homo sapiens
acccacgcgtcgcggacgcgtgggtcgacccacgcgtcggcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattc

SEQ ID NO: 66052 - DNA, 683 bp, Homo sapiens
  misc_feature (128)..(128): n is a, c, g, or t
  misc_feature (130)..(130): n is a, c, g, or t
aggagtcttgctctgtctcccaggttggagtgcagtggcccggtctggggtcattgcaacctccgccttctcggttcaagcgattctcttgcccaagcctcccgagaagctgggactacaggcgtgtncncccatgcccagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattc

SEQ ID NO: 66053 - DNA, 831 bp, Homo sapiens
tccttttttcctttgcaaagaaataaaaacaggagttatagttattgaataacttttttgttcttgttgccacttggcatttttgaggcatctctaggtagtttgttttgaaactaaagagaatgaccttggtgggttgagcaagaattcagaagttaatgatgttgggtaagagaacaatggtaagagagcaatctaagaatatatcacctactttaattttatatgagagtacatggaggtagctgtgatgtggaaatgtatccatgtaactttttatgtattttagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattc

SEQ ID NO: 66054 - DNA, 954 bp, Homo sapiens
  misc_feature (13)..(13): n is a, c, g, or t
  misc_feature (73)..(73): n is a, c, g, or t
cccccgcactccnccgcctatacgctgtcgcgccatctgcggcaccatctgtcccactcccaccccgcacacncatcaggccggctcgtcaacccgtgtccatctcggagggtctggcctgaccgcgcctcggaccacatgccactcatatgctcgcaaaacgccttctcctaatgacgctccgcatatcctcctccgcttgtctttccacgctatctcttgggcacaaacggccattgcgccttctcctccttctcccacccaacgcgtcctaccgtcttcgctcctgtcgcctagggttgcaatccataccccctgcatccgcggaactcttaaaccgccccagctctacagttctggagggtggtctcctggcctcggccgtccgaagcagctgggggatttatggatttattttcagtgtgaccaccatcgtgccccttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattc

SEQ ID NO: 66055 - DNA, 698 bp, Homo sapiens
gtttttgatagtatttatgtctgctgcggggatcaacgagaataatagtttctatatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattccaaaatacacaaacttcatcatcactcacaacactagcaaatgactaaatgaaagggccccttcggccccacgcggggagctttgcggccgttttccttta

SEQ ID NO: 66056 - DNA, 388 bp, Homo sapiens
agggctgtagcaagctatccggttcaatacactgctgttggcacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaaccggatagcttgccgggacctctagatcacctca

SEQ ID NO: 66057 - DNA, 894 bp, Homo sapiens
agtgggcgcgtgcatgttagcttttaccttatcaccccatctcgttccactctgtatcgtgcgatactaacacgttacggtttgtttcactcctcatctacccgctctatctgtcccaccgccccatgtagtcgatagagccaccctcgtctgtcgttcactcaagcgtccgccgcgctgggtgatgcacctggcgggcaggtcatccgcttacagctttgtcggggatcagacgaggcgagcagggccccagttgagttgctagtgcggtgtgctcgctactgacgaaagcggtacatagcgttcactcttgacctatcagcaatctaaggaagcgtccttgatttattcttgtgaaagccaaggggcggccatagatagccaccctgggacttcacgttacgcgtggccccgaatcgcgcttaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaggtgtacccgcgcaggctccttccctcgtctccaagctcttccgcttggtctct

SEQ ID NO: 66058 - DNA, 236 bp, Homo sapiens
ggatttgctggtgcagtacaactaggcttaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66059 - DNA, 259 bp, Homo sapiens
cgtcgaccacacagtagcttcaaaactgttcgatctgtttgttcccatgtagttttctaaagatggaaaaaaaggactttggtcatcaagactactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66060 - DNA, 2673 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66061 - DNA, 2398 bp, Homo sapiens
attagatagcttggaacgagctcagccatctggtttgcattagggcaggttggagatggtgcaagaccattgctatgtgatttttgccagaaactgaaagtgcattttgtttacagtttagaagacaaatcgtctttcattcacctgtacagttgtaagtagaggacacaggcccactaatctcagaagcttggttgagaaataatttatttggatcattatttgctcttttaaaatacatgaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66062 - DNA, 2186 bp, Homo sapiens
acccacgcgtcgcggacgcgtgggtcgacccacgcgtcggcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66063 - DNA, 3116 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaaaaaaaaaaaaaaaaaaaaaaaaaaaaaaaaaaaaaaaaaaaaaaaaaaaaaaaaaaaaaaaaaaaaaaaaaaaaggggggggggggacaaaaaaaccgggggggaaaaccttttttacaaagagggcgaccaccaagagagggggtataaaaacgcaggaggggagggagaaaaacaccggggggaggagaaaaacgcagcagtcgtgcctctggggagaggccccatgcgtgcgggacaagggcgacccccccaaccaatgtaggggccggaaaaaaaatgggtgatgggggaaccccgctatctcgcgccaattgtttcgtcttttaattactcactctccatagttaacaacacgaggagaaagaccaacagcaccagccgtaacataagacgaacgacttcaaaacacgcaaataagagcaacagcgacgagcacagca

SEQ ID NO: 66064 - DNA, 3045 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaaaaaaaattcggcacgaggaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagattccagctaggtcagggggggggggaaaacacatacaaaaaagggaagcccatggtcagggggattctgggttaaaatgtgccattttcccgggttgatggtgccacaactttgtagagagttttacaaaaacattgtgcttagtccgcg

SEQ ID NO: 66065 - DNA, 2110 bp, Homo sapiens
  misc_feature (37)..(38): n is a, c, g, or t
ccaatgcacaggatctgctagagcgcggcacgagagnnatggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66066 - DNA, 2112 bp, Homo sapiens
atcccccggaggcgttgaatggccaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66067 - DNA, 2085 bp, Homo sapiens
  misc_feature (14)..(14): n is a, c, g, or t
  misc_feature (20)..(20): n is a, c, g, or t
tgtcactgtccaanaaaggnatccagagttttgctcttgttgcccaggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66068 - DNA, 2533 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcaccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66069 - DNA, 2494 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttgggatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66070 - DNA, 2067 bp, Homo sapiens
ccgatgaagtataggtgcgaggccgggtttatatcagcgacgaggtgcgcctacccacgctagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66071 - DNA, 2145 bp, Homo sapiens
  misc_feature (128)..(128): n is a, c, g, or t
  misc_feature (130)..(130): n is a, c, g, or t
aggagtcttgctctgtctcccaggttggagtgcagtggcccggtctggggtcattgcaacctccgccttctcggttcaagcgattctcttgcccaagcctcccgagaagctgggactacaggcgtgtncncccatgcccagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66072 - DNA, 2293 bp, Homo sapiens
tccttttttcctttgcaaagaaataaaaacaggagttatagttattgaataacttttttgttcttgttgccacttggcatttttgaggcatctctaggtagtttgttttgaaactaaagagaatgaccttggtgggttgagcaagaattcagaagttaatgatgttgggtaagagaacaatggtaagagagcaatctaagaatatatcacctactttaattttatatgagagtacatggaggtagctgtgatgtggaaatgtatccatgtaactttttatgtattttagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66073 - DNA, 1934 bp, Homo sapiens
gtaccatccttcctctctcacgacgtgcactatgacccagctccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66074 - DNA, 2073 bp, Homo sapiens
  misc_feature (2)..(2): n is a, c, g, or t
  misc_feature (12)..(12): n is a, c, g, or t
  misc_feature (37)..(37): n is a, c, g, or t
  misc_feature (48)..(48): n is a, c, g, or t
ancctataaaanaagtttcccatggtaagctatggcngttctcttggnaacttgaactcactttcctcctgaggctttgatttgacattgcatttgcccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66075 - DNA, 1786 bp, Homo sapiens
cgacattgagagtggctgacgaaagagaaagagaactcagaagggagaataagatagagagaaaatgaggctagaaaaacatgcaggagctagaaaggtaaaggaacccctgaccccttgaccttccttccctctaccctcatggtcctcttactgtccttgactttcttctctgctttaacattccattctatatgtcaactgcataacacagggtacaatttctacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66076 - DNA, 1545 bp, Homo sapiens
  misc_feature (25)..(25): n is a, c, g, or t
  misc_feature (40)..(40): n is a, c, g, or t
aagcagtggtatcaacgcagagtgncattacggccggganaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66077 - DNA, 1539 bp, Homo sapiens
tgaccctagcaggatccttactaatggctgtaagaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66078 - DNA, 1532 bp, Homo sapiens
cctagaggacccgctgatccgcttaagaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66079 - DNA, 1357 bp, Homo sapiens
atcgtttggaccagccaactaattaactgcctatactatctctactatgtacacttctataaatcagttgaggcataaatatgatgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66080 - DNA, 1263 bp, Homo sapiens
  misc_feature (25)..(25): n is a, c, g, or t
  misc_feature (40)..(40): n is a, c, g, or t
aagcagtggtatcaacgcagagtgncattacggccggganattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66081 - DNA, 1920 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcatactaggcaggctgaggcaggagaatggtgtgaacccgggaggcagaggttgcagtgaaccgagatcacgccactgcactctagcctgggcaacagagcaagactctgcctcacagaaaaaaaaaaaa

SEQ ID NO: 66082 - DNA, 1730 bp, Homo sapiens
  misc_feature (1708)..(1709): n is a, c, g, or t
  misc_feature (1716)..(1716): n is a, c, g, or t
  misc_feature (1720)..(1720): n is a, c, g, or t
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagcctgggnnacagagngagnctccgtctca

SEQ ID NO: 66083 - DNA, 1680 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgacacccacggggtaccggctcgattcta

SEQ ID NO: 66084 - DNA, 979 bp, Homo sapiens
ttttttttttgagacagagtttcgctcttgttgcccaggctggagtaatagctcactgcaccgtccacctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66085 - DNA, 976 bp, Homo sapiens
caggagatcgagagcatcctggctaacacagtgaaaccctgtcctctagtaaaaatacaaaaaattagccaggcgtggcagcatgcgtctgtagtgcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66086 - DNA, 908 bp, Homo sapiens
gagagagagagagagagagagagagagagagagagagagagagagagagagagagagagagagagagagagggtaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66087 - DNA, 866 bp, Homo sapiens
gccaggctgatctagagatatccctttatcagacaagggtagcactctctctctcaggctgcagtgcaagtggtgcgatcttgaccctgcaacctctgcctcttgggctcaagccatcctctgacccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66088 - DNA, 1211 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattc

SEQ ID NO: 66089 - DNA, 1282 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattctgtatagctgaaggattgtaaatacaccaatcagtgctctgtgtctagctaaaggttttgtaaatgcacca

SEQ ID NO: 66090 - DNA, 370 bp, Homo sapiens
ggctatccggttcacagaggtatggcacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66091 - DNA, 619 bp, Homo sapiens
  misc_feature (23)..(23): n is a, c, g, or t
  misc_feature (39)..(39): n is a, c, g, or t
  misc_feature (79)..(79): n is a, c, g, or t
  misc_feature (103)..(103): n is a, c, g, or t
  misc_feature (149)..(149): n is a, c, g, or t
  misc_feature (204)..(204): n is a, c, g, or t
  misc_feature (259)..(259): n is a, c, g, or t
cctccaagttcaagtcccttttntgggccaattattgantgccaccagtaaactccttcctccctgaaaaaaggaaatncagagattaagagcatatagcccnccctagtgaagaaaaatggagtaaggagattaagttaagtgccccntgtccaagcgatgggatgaaagaagcttgtctcagagatcccagatcatggtccntataatggatattattcagaccttagtacagcaagacactctggccaccataaanaacgcagaaaagaaaaaaaggttaagcattgaaacaaaagacgatcgccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66092 - DNA, 341 bp, Homo sapiens
ctttctacgacattctacactcaattctccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66093 - DNA, 1965 bp, Homo sapiens
gttttctcatttgcaaccacccatgctggcatgaaagaaagtgaagctgctgggttgaactccatcttctgggggacatttgcagcctgcaggggcctggcaatcttttttgctacctgtttacagcctggaaccatgattgtgttgagcaacattggcagcctgacttcatctttatttctggtgctttttgacaagaacccaatttgtctctggatagcaacttcagtgtatggggcttcaatggcaaccacatttccgagtggtgtttcttggattgagcagtacacgaccatccatgggaaatctgcagcattttttgtaattggtgcttccctgggagaaatggctattcctgcagtcattggaattcttcaaggaaaataccctgatttgcctgtagttctgtatacctctttgggagcatcaatagctactggtattttatttcctgtgctatataaattagccacttcacctcttgatcgccagcgaaaagaagacagaaagagtgaggaccagaaagctctgctctctagctccgggctaaatgaatatgaggaagagaatgaagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatctttgaataactgccacttctaaggacgccattcagagcagagcattagcagaatttcaccatgctttggggattaaaatttttaggtccatattatagcaaatgctaaaaatttttgaaatgttctgtaattcccagagtcttccataaataaccaaatggtctcatacacgtacaataggatcttgttataacgctatcatttgacatgtgactgattaggaaatattttatggtctccacccctcagagcacccaaagaaggcattgtttttgagaaggggggtattctcagaatgagaccatgtaggagttgaattgattggttgaacaaattatcaggtatcaatatttttccaggaaagttgaggagaatagtttcataaaagagaaatgccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66094 - DNA, 936 bp, Homo sapiens
  misc_feature (158)..(158): n is a, c, g, or t
  misc_feature (384)..(384): n is a, c, g, or t
  misc_feature (392)..(393): n is a, c, g, or t
ctttaccccacgcttcagctccatgtgtgtactcggctcgcccccggccgtccccgctggggttacagtgccccaaggccaaacagcggtctgcacagccatcgcctccagctcagacagcgcggtccgacaccgcgacatctcgtcccccgggggtnaacccacccctctcctttgtccagttcaccaagcgacactccctcccgtattcactcctggtttcaagcagggctcgacatcctacactcttctcaagagggtctctccaccaccaaggggcccgctcagcctcaagggtaaaaattcaaggtgccacgcagggccacaaaggtcacgcaaggcaaccccagtgtcagagccttttcaagctgtccacgaacaaangggatccnngatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattc

SEQ ID NO: 66095 - DNA, 598 bp, Homo sapiens
aaggctcaggtacggaggccggggttgaatcggcagaggtgtcctacccacggcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattc

SEQ ID NO: 66096 - DNA, 962 bp, Homo sapiens
  misc_feature (85)..(85): n is a, c, g, or t
gttagactgctagaataaatgacgtgccgcgctgagagttttatcgatacataccggaacaggagaaacctgtaccaggtaacancttcgaacgaggacaatgcttactatacataagcgcgaggaggctgtcttgcactcatcgcgtattctgagagactcgctgcggcggcctcgcgggaccgtgttaagtatgatatattgcggtaaggcccagcgatttaatacaatgtacataagagggatacgtacaagactaagtttttccacaagaggtcagttccgtcacaagtgggcttcacaagcgcagatgtcaaacatcactaggtgcacagcaaggcacaaaagtcgagctagagttccaggtgtcgggcatttcaattgtcctcgagaaagggaatctagattaattcaaggcatcacacgactggcgctttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaaacaggatgcggccagattttgtgcttcttctttcactactacactctcgcacctt

SEQ ID NO: 66097 - DNA, 2438 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66098 - DNA, 2168 bp, Homo sapiens
tccgcccacgcgtccgcttacgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66099 - DNA, 3063 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaaaaacatataaacaataaaacaaaacagaacaacaaacaacagggggcgccaaaacagaaaacccacaggggacaaaaacacacgaaccaacaatactaaaaacaggaaggtcaaagaggcgcacttagaaaacacaacacataccgaggacacaaaccgacggcacagggaaaacgcagaacagggaccaacaaaagagcacaacaacagaggcgagaccacggggaacacccaaaaagcaaaaccacggggaaacacaaagccccgcgaaaagggcaaccccccaatgagccggcacaccgccaaggacatagaaaacggcgagacaaaacagcagacaacatgacacgacagcaaagccagagacaagacccagccacaccacacccg

SEQ ID NO: 66100 - DNA, 3076 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaaaaaaaaaaaaaaaaaaaaaaaaaaaaaaaaaaaaggggggggggggacaaaaaaaccgggggggaaaaccttttttacaaagagggcgaccaccaagagagggggtataaaaacgcaggaggggagggagaaaaacaccggggggaggagaaaaacgcagcagtcgtgcctctggggagaggccccatgcgtgcgggacaagggcgacccccccaaccaatgtaggggccggaaaaaaaatgggtgatgggggaaccccgctatctcgcgccaattgtttcgtcttttaattactcactctccatagttaacaacacgaggagaaagaccaacagcaccagccgtaacataagacgaacgacttcaaaacacgcaaataagagcaacagcgacgagcacagca

SEQ ID NO: 66101 - DNA, 2673 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaacgtatagatgggtgctggggggtgtgggcgtg

SEQ ID NO: 66102 - DNA, 2634 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggcttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66103 - DNA, 2603 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattcggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66104 - DNA, 2080 bp, Homo sapiens
cgatcatacgtgtgaacgattatcgtgacgatatcggtcagggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66105 - DNA, 2060 bp, Homo sapiens
aaggctcaggtacggaggccggggttgaatcggcagaggtgtcctacccacggcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66106 - DNA, 2344 bp, Homo sapiens
agccgaggcggggaccctctcctgacgctgcgctctctgcgaggcaacctttcacgtccatcgcttgtcatcttaggatccccatgttattttagcccagattggctagttctggggaggcagcatggtgggacgattctgtcccgagtccccgccaggctttgttcgggtcgccgctaccagcgcggtctccctagatcctccatccggggaacctcgccccgggtgcgggtacccggggccgcgcagcgctgcctcgagggtgtatggatgcaccgcgccggcgagagagaccgggggctgggcctgggagaccctagcgggggcgggggcgaagaagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66107 - DNA, 2398 bp, Homo sapiens
  misc_feature (158)..(158): n is a, c, g, or t
  misc_feature (384)..(384): n is a, c, g, or t
  misc_feature (392)..(393): n is a, c, g, or t
ctttaccccacgcttcagctccatgtgtgtactcggctcgcccccggccgtccccgctggggttacagtgccccaaggccaaacagcggtctgcacagccatcgcctccagctcagacagcgcggtccgacaccgcgacatctcgtcccccgggggtnaacccacccctctcctttgtccagttcaccaagcgacactccctcccgtattcactcctggtttcaagcagggctcgacatcctacactcttctcaagagggtctctccaccaccaaggggcccgctcagcctcaagggtaaaaattcaaggtgccacgcagggccacaaaggtcacgcaaggcaaccccagtgtcagagccttttcaagctgtccacgaacaaangggatccnngatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66108 - DNA, 2392 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66109 - DNA, 2543 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66110 - DNA, 2353 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgactaagcttggaactctgctaccccg

SEQ ID NO: 66111 - DNA, 1850 bp, Homo sapiens
  misc_feature (1705)..(1706): n is a, c, g, or t
  misc_feature (1712)..(1712): n is a, c, g, or t
  misc_feature (1759)..(1759): n is a, c, g, or t
  misc_feature (1775)..(1775): n is a, c, g, or t
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccacgactaatttcaaaatgctttttattattattattttttagacagagtnngactcngtctttaaaaaaaaaaaaagattcatgtccttagattagattgtaanccactgggcaggtacntgtgtctaatgttttgtgtggcacctctcccattgttagagctcaataaacgttcaacaacaatgaaaaaaaaaa

SEQ ID NO: 66112 - DNA, 1628 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcgaggcttcggggatacatctagaatcgaccat

SEQ ID NO: 66113 - DNA, 1460 bp, Homo sapiens
agtttgcagcgtcaggcagcgggtctgcgcccagcgagcggctccccagctcctgggaagatgcggacccgggacgcccccgtgagctcactgcgcctggctgacacgaggcgctcacagaacaaagcaagggctgggggatggcgcggccgcggggccggcgcgcagatcgctccggacccggacaccgcctgcgaggagcgccgaccagccgggaagggttcgcgctaggcggcgcccgggtcccgtcggccagggtgagcgtccggcccgcgtccgcgccacgcccgccgcgttcccctttcctctgcggcgggccgagagataaccctgcccgaggggtcccggcgcccgccccccacgcggtcgcactggaattcgcagcccctctcgggtccccggggcgcattttgcagtctgagtggcaatgcacttgctccaggacaggcggctaccccgccgcagcggaggcgcggacttttcttttggggggtctcgccggctcgccgcgctccccaccttgcctgcgcccgcccggagccagcggttctccaagcacccagcatcctgctagacgcgccgcgcaccgacggaggggacatgggcagagcaatggtggccaggctcgggctggggctgctgctgctggcactgctcctacccacgcagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaa

SEQ ID NO: 66114 - DNA, 1031 bp, Homo sapiens
  misc_feature (9)..(9): n is a, c, g, or t
  misc_feature (83)..(83): n is a, c, g, or t
  misc_feature (87)..(88): n is a, c, g, or t
  misc_feature (91)..(91): n is a, c, g, or t
  misc_feature (106)..(106): n is a, c, g, or t
  misc_feature (111)..(111): n is a, c, g, or t
  misc_feature (117)..(117): n is a, c, g, or t
  misc_feature (128)..(128): n is a, c, g, or t
  misc_feature (134)..(134): n is a, c, g, or t
  misc_feature (136)..(136): n is a, c, g, or t
  misc_feature (139)..(139): n is a, c, g, or t
  misc_feature (146)..(146): n is a, c, g, or t
  misc_feature (149)..(149): n is a, c, g, or t
  misc_feature (154)..(154): n is a, c, g, or t
  misc_feature (156)..(156): n is a, c, g, or t
  misc_feature (158)..(158): n is a, c, g, or t
  misc_feature (164)..(164): n is a, c, g, or t
  misc_feature (188)..(188): n is a, c, g, or t
  misc_feature (190)..(190): n is a, c, g, or t
  misc_feature (203)..(203): n is a, c, g, or t
  misc_feature (209)..(210): n is a, c, g, or t
  misc_feature (225)..(225): n is a, c, g, or t
  misc_feature (231)..(231): n is a, c, g, or t
  misc_feature (233)..(233): n is a, c, g, or t
  misc_feature (237)..(237): n is a, c, g, or t
  misc_feature (239)..(239): n is a, c, g, or t
  misc_feature (245)..(245): n is a, c, g, or t
  misc_feature (247)..(247): n is a, c, g, or t
  misc_feature (254)..(254): n is a, c, g, or t
  misc_feature (264)..(264): n is a, c, g, or t
  misc_feature (269)..(273): n is a, c, g, or t
  misc_feature (276)..(277): n is a, c, g, or t
  misc_feature (287)..(287): n is a, c, g, or t
  misc_feature (293)..(295): n is a, c, g, or t
  misc_feature (346)..(346): n is a, c, g, or t
  misc_feature (351)..(353): n is a, c, g, or t
  misc_feature (360)..(360): n is a, c, g, or t
  misc_feature (364)..(364): n is a, c, g, or t
  misc_feature (383)..(383): n is a, c, g, or t
  misc_feature (387)..(387): n is a, c, g, or t
  misc_feature (395)..(395): n is a, c, g, or t
  misc_feature (401)..(401): n is a, c, g, or t
  misc_feature (406)..(406): n is a, c, g, or t
  misc_feature (408)..(408): n is a, c, g, or t
  misc_feature (422)..(422): n is a, c, g, or t
  misc_feature (440)..(440): n is a, c, g, or t
  misc_feature (448)..(448): n is a, c, g, or t
  misc_feature (450)..(450): n is a, c, g, or t
  misc_feature (452)..(452): n is a, c, g, or t
  misc_feature (462)..(463): n is a, c, g, or t
  misc_feature (465)..(465): n is a, c, g, or t
  misc_feature (478)..(478): n is a, c, g, or t
  misc_feature (482)..(484): n is a, c, g, or t
  misc_feature (487)..(489): n is a, c, g, or t
  misc_feature (493)..(493): n is a, c, g, or t
  misc_feature (496)..(496): n is a, c, g, or t
  misc_feature (499)..(499): n is a, c, g, or t
  misc_feature (502)..(502): n is a, c, g, or t
  misc_feature (505)..(505): n is a, c, g, or t
  misc_feature (509)..(509): n is a, c, g, or t
tttcccccnctgctctgttttgccggcccccttgcccctcttgcccttccgccggcccccctgtcccggcgtcccccctctcnctcnngtntttgggccgtgccgnctggncgctcntttgccttccnttcccncnctnttctccnctntctgncncncccttntttttctttcccccccccctctgncnccgcctcgccccntttcgnnccctttttgttctcngtcccncntttncnctcgtncncccctgnccctcccccnccccnnnnnccnncccccccccncccccnnncccccccccccccccccccccccccccccccccccctcccccccccccccnccccnnncgccccncctnctccccccccccccgcccncgcnctcccccntccccncctcncncccccgtccccttnctcccccccccccccccncccccccntncncccccccccnncnccccccccccccncccnnnttnnncccnccngtntgnccncctncccactcttgctttattccagaatgctgtacatctattttggattgtatattgtgtttgtgtatttacgctttgattcatagtaacttcttatggaattgatttgcattgaacacaaactgtaaataaaaagaaatggctgaaagagcaaaaaaaattcggcacgaggaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagattccagctaggtcagggggggggggaaaacacatacaaaaaagggaagcccatggtcagggggattctgggttaaaatgtgccattttcccgggttgatggtgccacaactttgtagagagttttacaaaaacattgtgcttagtccgcg

SEQ ID NO: 66115 - DNA, 623 bp, Homo sapiens
cgctgcgaccggcgctccccggggcaggtggctgcatagtcttggcggaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtgaagcgggagtggaagaaggatctaaagggaaaaactgacatgtttatgttatggaaaaagaaatttttctaagtttcatcacaaactgtgtccagtttctctgtggtgttcatgaaatagctaaaagcaaatgaagtaaagggcatactatggtttttcacaaa

SEQ ID NO: 66116 - DNA, 2829 bp, Homo sapiens
  misc_feature (2687)..(2687): n is a, c, g, or t
agcggagcgtcttgcgccgccattgcggggaggctgtcctcagagcaggtctggcgcgccggtggctggaccggccccaggagcccagtcaccgggcgtcattggctcaggctgcggggccctcggcaccttctccctcccgggtccaccgcggcggcggcggcggcggcggcggcgacggcggcggcgtcagggggcggagcctgccgaagcgccctttgtctgcggaggtcaacatacctggcctaaggaggcaggattgagtgactctcactcaccactggtgttgctctttgaaagtggcgcttggcaccagcatgaactccccatcctcagcaatcccatcaggtgttttgggtcttcaacctaaaattctatcttacaagatccttgccaggatgcagatttgaatactatagtgaagtctgtacatgaagaaatgatgcttttagggaggaaaaaaaaaaggtaataacaaccttcaagagccccttcatctcaactcggcataaacaaggcaagattctgagagtggccgcccctggaagcagaaattattcttgtggctatccatgtggctcctgaggctctaatcagagatggggcacctttagtaccaggggagtgactgttgcccataaggtactggacatcaactttcaagagcagccccagctccttaagctgctggtcctggtgcatctgctgactttcatgtagaagatagcagagctttggcgacattacaacataagaactgcagagaggtgtaatcccagtggaagactgaatcgagagactcaaaaaggaaggaggggaacatggaggaggaagaaatgaatgatggctcacagatggtgagatctcaggaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtgaagcgggagtggaagaaggatctaaagggaaaaactgacatgtttatgttatggaaaaagaaatttttctaagtttcatcacaaactgtgtccagtttctctgtggtgttcatgaaatagctaaaagcaaatgaagtaaagggcatactatggtttttcacaaaggtttatggtcgtgtttcaaattttcatcatttcagtgaacatacttccacgttacattaagtgtgcctagcagtctgttgcattttgtaagctcacagttttttgttttgagatggaatctcactctgtcacccaggctggagtgcagtggtgcaatcttggctcactgcaagctccgcctcccgggttcacgccgttctcctgcctcagcctcccgagtagctgggactacaggcgcctgccaccatgcccagctaatttttttttttttttttttgggtatttttagtagagacggggtttcaccgtgttagccaggatggtcttgatctcctgacctcgtgatctgcctgccttggcctctcagagtgctgggattacaggcgtgagccactgtgcttagcaagctcactgttttagaaggttttatttttgtcttttgagacagggtcttgctttgttgtgggggctggagtgcagtggtatgatcttggctcactgcagccttgacctccctggctctagcatctttccaccccagccttctgagtagctgggaacacaggagcgtaccactacacttggctgattttttgtaaattttgtagagacagggtctccctgtgttgcccaggttggtctcggactcctgggagcaatctgcccatcttggcctaacagtgctgggattacaggcctgagccactgtgcccagccggtttcctttatttcattcaaaggaattttgaatttatcttagaacctttattttgaaggaagaaagtcttttttttttttgagctggagtttcactcttgttgcccaggctggagtgcaatggcatgatctcagcccaccacgacctccgcctcccaggttcaagtgattctgcttcagcctcctgagtagctaggattacaggcatgtgccaccacgcccagctaattttgtatttttagtagggatggggtttctccatgtttgtcaggctagtcttgaactccggacctcaggtgatccgccngcctgggcctctcaaagtgcttggattacaggcatgagccactgcatgtaatgaccagccactggtcagaattctttcaatcaagctgtgttaataagaatattgatgtgtggaaaataaaattttacaattctgtgccact

SEQ ID NO: 66117 - DNA, 2055 bp, Homo sapiens
  misc_feature (1913)..(1913): n is a, c, g, or t
gcggggtattgctgccgggggaggatttgctggggacccaaggcaccctcgcgtgagagccctgagagcgaatcgcttcgtctgacctcggggttgtctggggcgagggcacgaatcaccccaacctttccgaagcctggtggaatggcttgtgaactgatctcaaaagcagcccaagtcatccgtcgctgggccggggagggggacaccgcggcggccccgccgagtgctacctgggcactgagcctgtggggagaggcgacccagcggggtggagagagataagggaccagtaacgtccagcgtttgtccgtggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtgaagcgggagtggaagaaggatctaaagggaaaaactgacatgtttatgttatggaaaaagaaatttttctaagtttcatcacaaactgtgtccagtttctctgtggtgttcatgaaatagctaaaagcaaatgaagtaaagggcatactatggtttttcacaaaggtttatggtcgtgtttcaaattttcatcatttcagtgaacatacttccacgttacattaagtgtgcctagcagtctgttgcattttgtaagctcacagttttttgttttgagatggaatctcactctgtcacccaggctggagtgcagtggtgcaatcttggctcactgcaagctccgcctcccgggttcacgccgttctcctgcctcagcctcccgagtagctgggactacaggcgcctgccaccatgcccagctaatttttttttttttttttttgggtatttttagtagagacggggtttcaccgtgttagccaggatggtcttgatctcctgacctcgtgatctgcctgccttggcctctcagagtgctgggattacaggcgtgagccactgtgcttagcaagctcactgttttagaaggttttatttttgtcttttgagacagggtcttgctttgttgtgggggctggagtgcagtggtatgatcttggctcactgcagccttgacctccctggctctagcatctttccaccccagccttctgagtagctgggaacacaggagcgtaccactacacttggctgattttttgtaaattttgtagagacagggtctccctgtgttgcccaggttggtctcggactcctgggagcaatctgcccatcttggcctaacagtgctgggattacaggcctgagccactgtgcccagccggtttcctttatttcattcaaaggaattttgaatttatcttagaacctttattttgaaggaagaaagtcttttttttttttgagctggagtttcactcttgttgcccaggctggagtgcaatggcatgatctcagcccaccacgacctccgcctcccaggttcaagtgattctgcttcagcctcctgagtagctaggattacaggcatgtgccaccacgcccagctaattttgtatttttagtagggatggggtttctccatgtttgtcaggctagtcttgaactccggacctcaggtgatccgccngcctgggcctctcaaagtgcttggattacaggcatgagccactgcatgtaatgaccagccactggtcagaattctttcaatcaagctgtgttaataagaatattgatgtgtggaaaataaaattttacaattctgtgccact

SEQ ID NO: 66118 - DNA, 1305 bp, Homo sapiens
agcggagcgtcttgcgccgccattgcggggaggctgtcctcagagcaggtctggcgcgccggtggctggaccggccccaggagcccagtcaccgggcgtcattggctcaggctgcggggccctcggcaccttctccctcccgggtccaccgcggcggcggcggcggcggcggcggcgacggcggcggcgtcagggggcggagcctgccgaagcgccctttgtctgcggaggtcaacatacctggcctaaggaggcaggattgagtgactctcactcaccactggtgttgctctttgaaagtggcgcttggcaccagcatgaactccccatcctcagcaatcccatcaggtgttttgggtcttcaacctaaaattctatcttacaagatccttgccaggatgcagatttgaatactatagtgaagtctgtacatgaagaaatgatgcttttagggaggaaaaaaaaaaggtaataacaaccttcaagagccccttcatctcaactcggcataaacaaggcaagattctgagagtggccgcccctggaagcagaaattattcttgtggctatccatgtggctcctgaggctctaatcagagatggggcacctttagtaccaggggagtgactgttgcccataaggtactggacatcaactttcaagagcagccccagctccttaagctgctggtcctggtgcatctgctgactttcatgtagaagatagcagagctttggcgacattacaacataagaactgcagagaggtgtaatcccagtggaagactgaatcgagagactcaaaaaggaagttatgccttctcagaatgctgttttttctcaggaggggaacatggaggaggaagaaatgaatgatggctcacagatggtgagatctcaggaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccagcctaatttctaattctcttgctctcctttgtgatatgtccccaattcctacctctactactaacattgttttcttggagattaccactaatttccttccagtcaaatccagtggctacaaagccagttaggattgtgttgactttcccttcttgaaatgttcttccaccctggcttgtgatgca

SEQ ID NO: 66119 - DNA, 436 bp, Homo sapiens
  misc_feature (294)..(294): n is a, c, g, or t
ctccatcagccgctccagccgccccctgaagttgctcccaaagcgcacgtcatcctcaaacaccaggaccgggcaggccctggaccacctcttcccagatggagtaatggctgaggaagcagcccaccacgacctccgcctcccaggttcaagtgattctgcttcagcctcctgagtagctaggattacaggcatgtgccaccacgcccagctaattttgtatttttagtagggatggggtttctccatgtttgtcaggctagtcttgaactccggacctcaggtgatccgccngcctgggcctctcaaagtgcttggattacaggcatgagccactgcatgtaatgaccagccactggtcagaattctttcaatcaagctgtgttaataagaatattgatgtgtggaaaataaaattttacaattctgtgccact

SEQ ID NO: 66120 - DNA, 510 bp, Homo sapiens
tgtgcttattctgttgcggtgacgtacctcaaagaaacgggtatgcagtgttccatgggcaccagagatgctcgcagaggagcaagttcagaatgtgtcaagactctatccatagggtgttggtcaagttcactaaactgccagtgcacaggatacacatacatgtggtagtttttcttaaagtcccttaagagaaggtcaatgggatggtccccagccaaaagcctcttttccatatcaaaaatcttctgccattttaatctatttttcatcttttctttttccttttatcatcaaactcttgacacttgtatacaacccaccagcctaatttctaattctcttgctctcctttgtgatatgtccccaattcctacctctactactaacattgttttcttggagattaccactaatttccttccagtcaaatccagtggctacaaagccagttaggattgtgttgactttcccttcttgaaatgttcttccaccctggcttgtgatgca

SEQ ID NO: 66121 - DNA, 679 bp, Homo sapiens
tagttcgctcatccgtccatgccagatggattgtggggaaggtgattgggacaaaaatgcaaaagactgctaaagtgagagtgaccaggcttgttctggatccctatttattaaaggtgagaaacattcttgtttccgggtggctttggtaaatcaccaccatgtcctgggtcctaagcaaaaaaacatttatctctcagtaaagatgtcttgtctctcatctgctttgagccaggcattttgctggtctgtaggtataacacggtttacacattccaagaaaacagttaatgtcaatccactctaactgctgtagtcattctgtatgcaaagtactggccggatgaggtggctcacacctgtaatcccagcactttgggaggccgatgcggttggatcacctgagatcaggagttcgagaccagtctggccaacgtggtgaaaccccgtctctactaaaaatacaaaaattagctgggcatagtggtgcgcacctgtaatcctagctactctggaggctgaggcaggagaatctcttgaagccgggaggcggaggttgcaatgagccacaattgtaccattgcactccatcctggacaagagcaaaactctgcctaccatgcacaattcacaatagggtttgtgctcctataggaatctaatgccgctgctgatctga

SEQ ID NO: 66122 - DNA, 1790 bp, Homo sapiens
  misc_feature (1648)..(1648): n is a, c, g, or t
cgctgcgaccggcgctccccggggcaggtggctgcatagtcttggcggaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtgaagcgggagtggaagaaggatctaaagggaaaaactgacatgtttatgttatggaaaaagaaatttttctaagtttcatcacaaactgtgtccagtttctctgtggtgttcatgaaatagctaaaagcaaatgaagtaaagggcatactatggtttttcacaaaggtttatggtcgtgtttcaaattttcatcatttcagtgaacatacttccacgttacattaagtgtgcctagcagtctgttgcattttgtaagctcacagttttttgttttgagatggaatctcactctgtcacccaggctggagtgcagtggtgcaatcttggctcactgcaagctccgcctcccgggttcacgccgttctcctgcctcagcctcccgagtagctgggactacaggcgcctgccaccatgcccagctaatttttttttttttttttttgggtatttttagtagagacggggtttcaccgtgttagccaggatggtcttgatctcctgacctcgtgatctgcctgccttggcctctcagagtgctgggattacaggcgtgagccactgtgcttagcaagctcactgttttagaaggttttatttttgtcttttgagacagggtcttgctttgttgtgggggctggagtgcagtggtatgatcttggctcactgcagccttgacctccctggctctagcatctttccaccccagccttctgagtagctgggaacacaggagcgtaccactacacttggctgattttttgtaaattttgtagagacagggtctccctgtgttgcccaggttggtctcggactcctgggagcaatctgcccatcttggcctaacagtgctgggattacaggcctgagccactgtgcccagccggtttcctttatttcattcaaaggaattttgaatttatcttagaacctttattttgaaggaagaaagtcttttttttttttgagctggagtttcactcttgttgcccaggctggagtgcaatggcatgatctcagcccaccacgacctccgcctcccaggttcaagtgattctgcttcagcctcctgagtagctaggattacaggcatgtgccaccacgcccagctaattttgtatttttagtagggatggggtttctccatgtttgtcaggctagtcttgaactccggacctcaggtgatccgccngcctgggcctctcaaagtgcttggattacaggcatgagccactgcatgtaatgaccagccactggtcagaattctttcaatcaagctgtgttaataagaatattgatgtgtggaaaataaaattttacaattctgtgccact

SEQ ID NO: 66123 - DNA, 2861 bp, Homo sapiens
  misc_feature (2719)..(2719): n is a, c, g, or t
agcggagcgtcttgcgccgccattgcggggaggctgtcctcagagcaggtctggcgcgccggtggctggaccggccccaggagcccagtcaccgggcgtcattggctcaggctgcggggccctcggcaccttctccctcccgggtccaccgcggcggcggcggcggcggcggcggcgacggcggcggcgtcagggggcggagcctgccgaagcgccctttgtctgcggaggtcaacatacctggcctaaggaggcaggattgagtgactctcactcaccactggtgttgctctttgaaagtggcgcttggcaccagcatgaactccccatcctcagcaatcccatcaggtgttttgggtcttcaacctaaaattctatcttacaagatccttgccaggatgcagatttgaatactatagtgaagtctgtacatgaagaaatgatgcttttagggaggaaaaaaaaaaggtaataacaaccttcaagagccccttcatctcaactcggcataaacaaggcaagattctgagagtggccgcccctggaagcagaaattattcttgtggctatccatgtggctcctgaggctctaatcagagatggggcacctttagtaccaggggagtgactgttgcccataaggtactggacatcaactttcaagagcagccccagctccttaagctgctggtcctggtgcatctgctgactttcatgtagaagatagcagagctttggcgacattacaacataagaactgcagagaggtgtaatcccagtggaagactgaatcgagagactcaaaaaggaagttatgccttctcagaatgctgttttttctcaggaggggaacatggaggaggaagaaatgaatgatggctcacagatggtgagatctcaggaatcactgacgtttcaggatgtggccgtggacttcaccagagaggagtgggaccagctgtaccctgcccaaaagaacctctatcgagacgtgatgctggagaactacaggaatctagttgcactggggtatcagctttgtaagccagaggtaatcgcgcagttggagctagaggaagaatgggtgatagaaagagacagcctgctggatactcatccaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtgaagcgggagtggaagaaggatctaaagggaaaaactgacatgtttatgttatggaaaaagaaatttttctaagtttcatcacaaactgtgtccagtttctctgtggtgttcatgaaatagctaaaagcaaatgaagtaaagggcatactatggtttttcacaaaggtttatggtcgtgtttcaaattttcatcatttcagtgaacatacttccacgttacattaagtgtgcctagcagtctgttgcattttgtaagctcacagttttttgttttgagatggaatctcactctgtcacccaggctggagtgcagtggtgcaatcttggctcactgcaagctccgcctcccgggttcacgccgttctcctgcctcagcctcccgagtagctgggactacaggcgcctgccaccatgcccagctaatttttttttttttttttttgggtatttttagtagagacggggtttcaccgtgttagccaggatggtcttgatctcctgacctcgtgatctgcctgccttggcctctcagagtgctgggattacaggcgtgagccactgtgcttagcaagctcactgttttagaaggttttatttttgtcttttgagacagggtcttgctttgttgtgggggctggagtgcagtggtatgatcttggctcactgcagccttgacctccctggctctagcatctttccaccccagccttctgagtagctgggaacacaggagcgtaccactacacttggctgattttttgtaaattttgtagagacagggtctccctgtgttgcccaggttggtctcggactcctgggagcaatctgcccatcttggcctaacagtgctgggattacaggcctgagccactgtgcccagccggtttcctttatttcattcaaaggaattttgaatttatcttagaacctttattttgaaggaagaaagtcttttttttttttgagctggagtttcactcttgttgcccaggctggagtgcaatggcatgatctcagcccaccacgacctccgcctcccaggttcaagtgattctgcttcagcctcctgagtagctaggattacaggcatgtgccaccacgcccagctaattttgtatttttagtagggatggggtttctccatgtttgtcaggctagtcttgaactccggacctcaggtgatccgccngcctgggcctctcaaagtgcttggattacaggcatgagccactgcatgtaatgaccagccactggtcagaattctttcaatcaagctgtgttaataagaatattgatgtgtggaaaataaaattttacaattctgtgccact

SEQ ID NO: 66124 - DNA, 648 bp, Homo sapiens
cgctgcgaccggcgctccccggggcaggtggctgcatagtcttggcggaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaagtattttaataagcggaaaacctactttgctcacgatgcccttcagcagtgcacagttggggatattgtgcttctcagagctttacctgttccacgagcaaagcatgtgaaacatgaactggctgagatcgttttcaaagttggaaaagtcatagatccagtgacaggaaagccctgtgctggaactacctacctggagagtccgttgagttcggaaaccacccagctaagcaaaaatctggaagaactcaatatctcttcagcacagtgaagcgggagtggaagaaggatctaaagggaaaaactgacatgtttatgttatggaaaaagaaatttttctaagtttcatcacaaactgtgtccagtttctctgtggtgttcatgaaatagctaaaagcaaatgaagtaaagggcatactatggtttttcacaaaaaagaacagaaaaaaaaagtcgacg

SEQ ID NO: 66125 - DNA, 153 bp, Homo sapiens
aggaagtacagatgcatttattgagcacctactatagtcatgccaaaaactgtgctaggctctttaacataaattatctctttcacttgcctataaaaggataagtttctgtattatgagtgcctagattaatgatggatgtcagagtaatgc

SEQ ID NO: 66126 - DNA, 173 bp, Homo sapiens
cccatgaatctgcattttaaatgagctccctgcgtaactcttatccatgttataattggagaaccaccactctaagctataccagatccctccaaaactcaaaagccccttttacctcagtgcccttgctatttctattcacactgtatggaatgtcctcaccttccaagcct

SEQ ID NO: 66127 - DNA, 1468 bp, Homo sapiens
tttttttttttttttgtagagacaaggtctcactgtgttgctcaagctggtctggaacttatggcctccagtgaaccacccccttcttggtctcccaaagtgctgggatgacaggcattagccaccacacatggctctggtcttatatattaaacatacagagatgaccagattataattcctgccctccagagtcttgctattagtagagtagatagacaaaaacaaaagtatgccaaaaaatgtggcagcatgctacatgatgtcataaaggtctgaccttttttttaaaatagcagaccagactttgggccatggggaaagaaagtgctgtgttctaccccaagatattatggaagattcttaagaatgggacttttagtctaagaaaaaacagaatgtggcagggagacgagggccttctaggcaaagagaatgaatgaatagcttatacgaaggcacaggggcaaggggagaacaaacaaaacaagcatagactgttcaagaacttcaagtgacttaggtgactcctgagctcagaattcatgcggcaggagcagcagcgggagatgactctagaaagctggactaggaaggtaccaggaaaggccttgtaggcgttactaaattcgttaatggacagtgctgagagaactgttcatgtgttaattaatctcattaatatatagtcacccagtgtaggtgcagaaaaggaattaagaaatattcatgcagccaaaaaaagaatgagattgtcttttgtggtaacatgaatggaactggaggccattattcttagcaaactaacacaggaacagaaaaccaaatactgcatgttctcacctataagtggaagctataaatgataagaatttattaacacaaagaaggaaacaacagacactggggtctacctgagggtggagggtgggaggagggagaggagcagaaaaataaccattgggtcctgggcttaatacctgggtgatgaaataatacgtacaacaaaccttggtgacatatgtttacctatgtaacaaaccttcatgtgtacccctgaacctaaaataatagttaaaaaaagtatttaaattatattttgtagtctttggtatctttaaattactaaatatttatttgtgctttcttgagtaaaaggcaaaatagtaacagtatagcttgttttataattataataaagtataagaaataaaatctattcaaagttagcattctaccagatgaaacattttataatgccacgtataattttgatataaaatattttaaatacatactcaaaaaggagtatttatttcatatagtattaacttgtcttaggaacaactctgcaattgtaagataagatgagcagcaacaaaatgtaatacacctggatttaagaggctagctattcataacagcaaaagccaacaaaaagttgtttcaaaggcaatcaggcatcaag

SEQ ID NO: 66128 - DNA, 234 bp, Homo sapiens
agcgagactccatctcaaaaaacaaaaaaagctcaaaacaaaagacgggctttccagagagagggaggagagaagacagcaaaaaccgtaaattgatctgtttccacttagccatgtttctaagtcacttttttgtctgggaactgtttcccggaatttaatttttttctgaggcagtgatcatatgcactgcagcctggatgatatatgcaatcatatgatcgcttgaggtgt

SEQ ID NO: 66129 - DNA, 1057 bp, Homo sapiens
aaggcagcatagtaaccattctctaaccaataatttcctgtatggaaacttccagtttttgcatgtttacttctgtagactttttggcaactacaggaattttgattcctgtctacccgtatggcaggccattcctcttggggctgattaggaaaagcaggaactatgagtgaagtatagaccagaagaggaggcagatgtccaagtcagtgtagaggtgttggcaggggaaccttgggagcagagagggctgacagctccttcacttgggcacggagctgggattcagcaaagagggacccatggtttatcctgggcataggcaggctgatgaaatgtgtgcctaggaaggaggataaataaaggatctgcagaagctgttctgtgtctaccattggaggcactctgcatatttgagaggagagtgggacgcagagagtaaggtcagcagtttgagggatttaataaaaaacagatactgacagtctgaatggaggaccagccagaaaagaatgcctcctatcttatttatgtctgaatatggcaaatgtataagcatctcctggcaaatgtggggaaaggagattctgctaagttttgagctgggaagaaatagtaaatgggagttaatggtataggaggtctttattagtaattaagacatataaagcatcactgacatgctctgtatttaattatttgttttaatgacttctaaaatccttttatagtggcttttataagttcagttctgaccttagtctctagtcacttttttcccataaagtttgaagttcaatagcaaatgtttctaatttgaagtttcagaaggccttcagttagtgattgggaaaggactatatattagctgtcaaaaaaagttgtctagataacccatgttgcgaggattcagatacaattgtaagagccccatttattttttgagtgctttccaactggaatcagtgatgggcatttatctacatgatctaatttcattttcactataattccaggaatgggcattcttaacttcatttcacagatgaggcaactg

SEQ ID NO: 66130 - DNA, 303 bp, Homo sapiens
agcttgggctctggaggcccttgggggcggctgcgccgggaaccctggccctttatccccaaccccaccccagaaatagggtccccggaggcgaacaagccgaggggcggagtgggccagggatcacctgccccgcaatgacctgcgccccgcccccaggcctgctggagctctcgcccgtggagcggggcgtggtgagcatcttcggcgtggccagccggttcttcgtggccatgagcagcaagggcaagctctatggctcggtgagtaccgcaggggtctggctaggcacctagttgggaa

SEQ ID NO: 66131 - DNA, 1220 bp, Homo sapiens
gggagcgggcgagtaggagggggcgccgggctatatatatagcggcctcggcctcgggcgggcctggcgctcagggaggcgcgcactgctcctcagagtcccagctccagccgcgcgctttccgcccggctcgccgctccatgcagccggggtagagcccggcgcccgggggccccgtcgcttgcctcccgcacctcctcggttgcgcactcccgcccgaggtcggccgtgcgctcccgcgggacgccacaggcgcagctctgccccccagcttcccgggcgcactgaccgcctgaccgacgcacgccctcgggccgggatgtcggggcccgggacggccgcggtagcgctgctcccggcggtcctgctggccttgctggcgccctgggcgggccgagggggcgccgccgcacccactgcacccaacggcacgctggaggccgagctggagcgccgctgggagagcctggtggcgctctcgttggcgcgcctgccggtggcagcgcagcccaaggaggcggccgtccagagcggcgccggcgactacctgctgggcatcaagcggctgcggcggctctactgcaacgtgggcatcggcttccacctccaggcgctccccgacggccgcatcggcggcgcgcacgcggacacccgcgacagcctgctggagctctcgcccgtggagcggggcgtggtgagcatcttcggcgtggccagccggttcttcgtggccatgagcagcaagggcaagctctatggctcgcccttcttcaccgatgagtgcacgttcaaggagattctccttcccaacaactacaacgcctacgagtcctacaagtaccccggcatgttcatcgccctgagcaagaatgggaagaccaagaaggggaaccgagtgtcgcccaccatgaaggtcacccacttcctccccaggctgtgaccctccagaggacccttgcctcagcctcgggaagcccctgggagggcagtgccgagggtcaccttggtgcactttcttcggatgaagagtttaatgcaagagtaggtgtaagatatttaaattaattatttaaatgtgtatatattgccaccaaattatttatagttctgcgggtgtgttttttaattttctggggggaaaaaaagacaaaacaaaaaaccaactctgacttttctggtgcaacagtggagaatcttaccattggatttctttaacttgt

SEQ ID NO: 66132 - DNA, 402 bp, Homo sapiens
taacagtctggactaaagactatctctggctcagtctctaacaagctgagaaatgacccagccccacagtcatcctggctgacttcttccttgcatctagttcttgctgttcaattgagcttgcacaaattttatccttcaagataaatgtgatgatatttgacagttgccttatggctagctgaagaaagtctttgtcagctaagaaacaggaaaaggatcctttaactttctgcacaggctttctttatctctggttcatggttccttcctcatgttaaactcgttccttcatacacagccacacaaagtccttgccctttcctgaccccagtcctgcacctgatgacttcagttcctctctatgactttgaacttggaataaatttttattttcacttg

SEQ ID NO: 66133 - DNA, 417 bp, Homo sapiens
ggatccatggaaagcaccttcattcaatgtaaatgaagaagtatttgctgacacaaatgatacctacattaagtggattttcctgaagaacaattatggagaattgaggagctgctttttctgcattttgcaaggcaagatagggaatacagttaggcctccaagagcacattttcacaattgaaagtatgtgtgagtgtggggtttggggggttggtggtgagaggacagtggttgaatatgctttgccagggatgcctatgatggcaagaacttgctggaaaagtgatcccgtggagtctctagaagaaacccagaacaatgaggctggccacaggtaaatcttaggcataagaaaacaagagtgtggatgatccaacagggagggggagtataaagagaattgggaagcagaat

SEQ ID NO: 66134 - DNA, 485 bp, Homo sapiens
atccaggtagcctcaccctgagtggcagcctggctgggtgagttctaaaaatgcccaagacctccaagactaggtgagatctgaagtaatgaaatgcctccattcactaaaggcctgaaattgtcctgactgcctcagtcccacggaccaagaagagcctttcaagctgtgatcccaatacttgtggctgctgtgagaataaggaaagcagtctaggcctccagtggaaggatcagatgtttgcccttcatacctcagagagccttcatccaagtaagatgggtggtgaggagctgtggatgacagcatgaaggatgaggactgatgcagcagccataattagattataggtttccatgggatgtgccatgactgcttacaaattgggcccagccatggaattgagttatcaactaagctgattcctgaggcacagatcatcctgtcctccacaacatgattaaagactacaaatccgctcaaaa

SEQ ID NO: 66135 - DNA, 2575 bp, Homo sapiens
cggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggaaaccgcctgtacgtccacccggactcccccaacacaggagcgcactggatgcgccaggaagtttcatttgggaaactaaagctcacaaacaacaagggggcgtccaacaatgtgacccagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgagattactcagctgaaaattgataataacccctttgccaaaggattccgggagaactttgagtccatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagatgcttcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcagcccgccagggtcagggaaaggactcacctgactttggacagctggcctgggctccccctgctcaaacacagtggggatcagagaaaaggggctggaaaggggggaatggcccacatctcaagaagcaagatattgtttgtggtggttgtgtgtgggtgtgtgttttttctttttctttctttttattttttttgaatgggggaggctatttattgtactgagagtggtgtctggatatattccttttgtcttcatcactttctgaaaataaacataaaactgttgaa

SEQ ID NO: 66136 - DNA, 198 bp, Homo sapiens
acctgcaggtcctagttggtcttgacaaatttgaggagatgtggctgagactgaagaagagataccaaataggactcctcataaagtagaaaccttttactcaaaagggcatttttcagggcatgttgtagttcctgcctgtttctttactgtctgtgaccttttttaaatattattaaacattctttcacaacatcg

SEQ ID NO: 66137 - DNA, 2493 bp, Homo sapiens
tgaggtcgtgaacagggaatttaacacatatgttaatgagaaaatgccaattaaaagttgttaattttatcgctaataagtgaattttttccccatatcccttctgggcttactgtgttcagtttttgtcagcgtctcataagaaggctatttttatttctattagagagacagctatgatggcttggataatcaggatggatgggaatgaggagcttgagaattccttaagttcacctcttaccttggctggaaagttgcaatgattttcatcagtcatgctctaacctagaaagccagaaatccaggaattgtgggaccagcatatcagcaactcgaagaatcaaggatcccagaccaggatacgataccttgccaagggatagaggtcaggaagactatatcccacctgcactatacagcctgtggtgactctgtctgaaagacccctggacttaaagtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatccaatttcgtttagtcccaacactgtcctctttggctcttaggaagatgtgggcaattcagacccttggccccacagtgccagtgtctcattaaaaaacactggcagttacctggtttcaaaaagaggagagctgcatcccgcaggtggatgcaccagtgagcaggtggctcttgccatttggcttgccagtcccaagccctaaatttctattcacccaatagcctcatcacaggttatgtcatgtcgacacatgtagtgttttctatttgatttttggagaatgccacaaaagactctgcaatgggaaggaggacaggagatagaaggagaaaccgggggcaatcttaactactcttgtgtgccaccttcctctgagatttgaatgcacagatctcagctggaggtatgaaattattacagaaaaagagacaaaaaaatccttatatcgtgtcagagcgtttctcagtttttgtgtgcctgtgtgcacatgtgtgtgcgagcgtgtgtgtgtgtggacttgctcacgcgggcacatatgctgtaagcacatgtgttcattgtgcgtatgtgtgtgcatgtgtgcgcgtattacgcttgctaaaatttgttctgaaacatcagggaatctactattcagaaaaattatttccctcttagatcttttcactttaaatttttccattaagtataaagttcagttagttcttaaatcaaggtcacttgcatggtgggggtcgtataaaactcttgacactgtctagacccttttctggatgtgaatacttttgaagaggatcaactattggcctcattaatgatatccagtatccataaggtgagttcatcaaggatgtgtgtttattttgaatcatgcctacttaaattattaatacaagacaattaacaaattgacagttaccatttgctttctcatcattcctcattaccatttattttatagcaagtctgctatgtgtggaccagggcttcggcttctgtggttagtatgggaagaataaattgttgaaataaaaatacccagactattcagttcacaagaagccccccaaaagaacagtaaattgtgttgtatgttcatttggaataaagcaatatttttaccactgctaaggtgaactgaaacctctcctgaagatttgtctgtttatttaccctcactttcatgggacatatgaggaaattagtgttcacatatccagtctttttccaattattggtggtgttgagttgttatgtttacactgttttaaataaaaaggcaccgtatttgaaagc

SEQ ID NO: 66138 - DNA, 405 bp, Homo sapiens
tgttttcattccaccccagcaggagtctatcctcttgctgcagcccagggcaaagaagtggcatgctccataggaatgccttcagaaggacacccccgtcaccccgaagtaggctaggtggaattgtgggaccagcatatcagcaactcgaagaatcaaggatcccagaccaggatacgataccttgccaagggtaggtcttaaaacagcagtggaatttagggagggtgtctttaatgccatagctttaagttaagttttaagttccttggggttttattcattgatttattcattaactggctatatatgcttactgccatctttgttctacaaaaggtgaaccaactttgatgtatagttgtgatggaaaataggtatcagggaaacattagattagaaaga

SEQ ID NO: 66139 - DNA, 2548 bp, Homo sapiens
tgaggtcgtgaacagggaatttaacacatatgttaatgagaaaatgccaattaaaagttgttaattttatcgctaataagtgaattttttccccatatcccttctgggcttactgtgttcagtttttgtcagcgtctcataagaaggctatttttatttctattagagagacagctatgatggcttggataatcaggatggatgggaatgaggagcttgagaattccttaagttcacctcttaccttggctggaaagttgcaatgattttcatcagtcatgctctaacctagaaagccagaaatccaggaattgtgggaccagcatatcagcaactcgaagaatcaaggatcccagaccaggatacgataccttgccaagggatagaggtcaggaagactatatcccacctgcactatacagcctgtggtgactctgtctgaaagacccctggacttaaagtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatccaatttcgtttagtcccaacactgtcctctttggctcttaggaagatgtgggcaattcagacccttggccccacagtgccagtgtctcattaaaaaacactggcagttacctggtttcaaaaagaggagagctgcatcccgcaggtggatgcaccagtgagcaggtggctcttgccatttggcttgccagtcccaagccctaaatttctattcacccaatagcctcatcacaggttatgtcatgtcgacacatgtagtgttttctatttgatttttggagaatgccacaaaagactctgcaatgggaaggaggacaggagatagaaggagaaaccgggggcaatcttaactactcttgtgtgccaccttcctctgagatttgaatgcacagatctcagctggaggtatgaaattattacagaaaaagagacaaaaaaatccttatatcgtgtcactaaaatcatgctaatagaaatgtttttccttgagattgtttagaggctctggaggagcgtttctcagtttttgtgtgcctgtgtgcacatgtgtgtgcgagcgtgtgtgtgtgtggacttgctcacgcgggcacatatgctgtaagcacatgtgttcattgtgcgtatgtgtgtgcatgtgtgcgcgtattacgcttgctaaaatttgttctgaaacatcagggaatctactattcagaaaaattatttccctcttagatcttttcactttaaatttttccattaagtataaagttcagttagttcttaaatcaaggtcacttgcatggtgggggtcgtataaaactcttgacactgtctagacccttttctggatgtgaatacttttgaagaggatcaactattggcctcattaatgatatccagtatccataaggtgagttcatcaaggatgtgtgtttattttgaatcatgcctacttaaattattaatacaagacaattaacaaattgacagttaccatttgctttctcatcattcctcattaccatttattttatagcaagtctgctatgtgtggaccagggcttcggcttctgtggttagtatgggaagaataaattgttgaaataaaaatacccagactattcagttcacaagaagccccccaaaagaacagtaaattgtgttgtatgttcatttggaataaagcaatatttttaccactgctaaggtgaactgaaacctctcctgaagatttgtctgtttatttaccctcactttcatgggacatatgaggaaattagtgttcacatatccagtctttttccaattattggtggtgttgagttgttatgtttacactgttttaaataaaaaggcaccgtatttgaaagc

SEQ ID NO: 66140 - DNA, 2494 bp, Homo sapiens
tgaggtcgtgaacagggaatttaacacatatgttaatgagaaaatgccaattaaaagttgttaattttatcgctaataagtgaattttttccccatatcccttctgggcttactgtgttcagtttttgtcagcgtctcataagaaggctatttttatttctattagagagacagctatgatggcttggataatcaggatggatgggaatgaggagcttgagaattccttaagttcacctcttaccttggctggaaagttgcaatgattttcatcagtcatgctctaacctagaaagccagaaatccaggaattgtgggaccagcatatcagcaactcgaagaatcaaggatcccagaccaggatacgataccttgccaagggatagaggtcaggaagactatatcccacctgcactatacagcctgtggtgactctgtctgaaagacccctggacttaaagtattcatccagtggtttaaaaacccaacgaaatacatcaataaatatgcaactgccttcaagagagacaaacccctattttaatagcttggagcaaaaggacctggtgggctattcatccacaagggccagttctgtgcccatcatcccttcagtgggtttagaggaaacctgcctgcaaatgccagggatttctgaagtcaaaagcatcaaatggtgcaaaaactcctattcagctgacgttgtcaatgtgagtattccagtcagcgattgtcttatagcagaacaacaagaagtgaaaatattgctagaaactgtccaggagcagatccgaattctgactgatgccagacggtcagaagactacgaactggccagcgtagaaaccgaggacagtgcaagcgaaaacacagcctttctccccctgagtcccacagccaaatcagaacgagaggcgcaatttgtcttaagaaatgaaatacaaagagactctgcattgaccaagtgacttgagatgtaggaatctgtgcattctatgctttgctcaacaggaaagagaggaaatcaaatacaaattatttatatgcattaatttaagagcatctacttagaagaaaccaaatagtctatcgccctcatatcatagtgttttttaacaaaatatttttttaagggaaagaaatgtttcaggagggataaagcttaccattaaagcttttgggtagaattctgaatccaatttcgtttagtcccaacactgtcctctttggctcttaggaagatgtgggcaattcagacccttggccccacagtgccagtgtctcattaaaaaacactggcagttacctggtttcagccatttggcttgccagtcccaagccctaaatttctattcacccaatagcctcatcacaggttatgtcatgtcgacacatgtagtgttttctatttgatttttggagaatgccacaaaagactctgcaatgggaaggaggacaggagatagaaggagaaaccgggggcaatcttaactactcttgtgtgccaccttcctctgagatttgaatgcacagatctcagctggaggtatgaaattattacagaaaaagagacaaaaaaatccttatatcgtgtcactaaaatcatgctaatagaaatgtttttccttgagattgtttagaggctctggaggagcgtttctcagtttttgtgtgcctgtgtgcacatgtgtgtgcgagcgtgtgtgtgtgtggacttgctcacgcgggcacatatgctgtaagcacatgtgttcattgtgcgtatgtgtgtgcatgtgtgcgcgtattacgcttgctaaaatttgttctgaaacatcagggaatctactattcagaaaaattatttccctcttagatcttttcactttaaatttttccattaagtataaagttcagttagttcttaaatcaaggtcacttgcatggtgggggtcgtataaaactcttgacactgtctagacccttttctggatgtgaatacttttgaagaggatcaactattggcctcattaatgatatccagtatccataaggtgagttcatcaaggatgtgtgtttattttgaatcatgcctacttaaattattaatacaagacaattaacaaattgacagttaccatttgctttctcatcattcctcattaccatttattttatagcaagtctgctatgtgtggaccagggcttcggcttctgtggttagtatgggaagaataaattgttgaaataaaaatacccagactattcagttcacaagaagccccccaaaagaacagtaaattgtgttgtatgttcatttggaataaagcaatatttttaccactgctaaggtgaactgaaacctctcctgaagatttgtctgtttatttaccctcactttcatgggacatatgaggaaattagtgttcacatatccagtctttttccaattattggtggtgttgagttgttatgtttacactgttttaaataaaaaggcaccgtatttgaaagc

SEQ ID NO: 66141 - DNA, 527 bp, Homo sapiens
gcaacactaagcacccgttcccaacaatttggtggcccgtaggggattaacattcccctctgggacagtctttggtcctctctcatggggaggtgccccactgcccattgtagcagcccctggaggacagccaggacctacccggagcaaggaatatagttggattctcagcaacgcagggaaagagagaggcttgcaggaccacagtgaccaggtgactccatgcacgggccaaggtcaaaggtctcttagcacaggccaccactagaatttccagcacaccagcaccaacccagggaccaccttctcatcaaagggtggaaggaagggaaactcgagcccacctgggaaggcccctatctggtgctgttaaccaccgagactgccgtccgcacagctgagaaaggatggacccaccatactctagttaagaaagcagcttcctcgtcagaatcatgggttgctgtaccaggattgagtcctaccaagttgaagttaaagaaagcttaatttttatataccttcta

SEQ ID NO: 66142 - DNA, 511 bp, Homo sapiens
ataaactgtggcacactcttagatcttttaaagagatttagtaggaactccatttgctgatatagagcagtctctgagttatgttgtgcaatgaaaaaatcaagcagcagagcagtataaatggtgtaatccattttccacataacttttaaaatgacacaccatatactttggtaaatgcacaaattctttttcaatggaaaatctacaagaagctgataacagtggcaactttgagggaaggatgagaagagaggttcttacctttcattcagtactgcttgattttcctacttcctactttgtgcattgattagttttagtggagaacttcagtaagtgtcatctgaaaggtggagttatgggacaattttggtttctcctttagagttttctgtaaaggatattcaataattgaagattctcaggccatataccagatacaccaagtttgggtggagatgctggcatgggactctagaaatcagcttgtcgtgtgattctgctcatc

SEQ ID NO: 66143 - DNA, 471 bp, Homo sapiens
aggctctggggagtgagtatgaggaaagagcaaacgtgggtgacgctgtcagggagtgaaaggatggaatgaggtgaggcgctagtttgagtagtttgaggccaaagcagggtggaaggacggcggtggtggtttttataggatcaaacagattttgacaaaatgaaacaaaagctatctgacaaaagggtagattgaataaatatgctggatatgtacacaggttaaagtgtttccatcacatgcagccagttcctgcttagttccatgtgagttaggcactgtgagggacggtcggtggcagagttttaattccaggcgagtacagcagccgggctgcttcctctattgctcaactgatgtgtgttcagaggatccaaactcatttcactgtcattctaaggaaaacatcatggacaatgtaaattttattctctttctaccctgtttaaaaaaactaaaaaaaaaacc

SEQ ID NO: 66144 - DNA, 1656 bp, Homo sapiens
tgcaacggagggtgttcctccctgagaaaagtagtagccagattgcctaaaaagatagacagggaagcttggcaccagaattgggaagagaaagaaagaacatatgtgaaggattggaacatgttcaagaaaagaatttaaaaggaaaggggcgtagaattcttggaatgacttacagaaaagcttaccaaggacaatcaccagattcagcctttccatttgctccatttgcacttgtgaaaaattacagaagctgtgttcataaggcttattaggtaattggtgataaagccagcagagagaggaaaatgagaatttcagctgaactaaggctaggtcacttttaacaatttgtgatgacccttttctctgcaacagagaagcttaggagcccggcactagatccagcccaccatttgctagattgggccaaatgtattttagattgtttgagaaaatgtccctaaaatgtgatattatggacattcctacactgaagatgaactaagtcttacaataaagaaaacaacatgtatataacccaacatctgactgtcctgcatacctcagctccatacagaatttcctataacttatgcacaaatttaccgcagttctggagtagaatataataaattaatgtccatgtctttagagcaaattaaagctggaaaacacagcataactcgggtcaggttaccagcgaggattgctatctctgtctttttttatctccttccttctttccttccttcctatttttttctgtggcagtactatggctcttgagagccaatgttaaatcttcaggaagaactggtttaagagttgccactaatactttgccagcaaagaccaaaactggcatttgcatggtttaattcaggatataagaaaagggaattttattaattaagctataagctccttgaagattcatgaataaaattatcaccttgaattgacctctacagaaagggcatttggctgctggtttcatagtaactagattgttaaacaaatggcatgagtttctttccttcacagggatcctatatgttattggtctaaaatccttgggtcttaaaggattttagcaagattttagcagacagaaactggatggggaccacatctccagcagaaacaatggcataggtaagcaaagaagagtggtagctagggcaagctccaagaattgccataaagaccctgttctgcttaacatgaagggcaagagaaaaatgtagttgagtttaagagagaaaaagtaggtcagagcagattcattaccttactaagaagtttggattttattctgtaaacagagtagaaatataaggtaatttgatctacgttttaggattattctggccctggtgtgcaggatgactataatgtgaatctggaaggagatagacaagttaggaagaagtttgtggtccaggccagagataactggagtccaccctagggtgttggtgggagaggtaggagatgaatagagtctatagaatttaacaagatattggccgggcgcagtggctcatgcctgtaatcccagcactttgggaggcctaggcgggcgcatcacgaggtcaggaaatcgagaccatcctggctaacacggtgaaaccctgtctctactaaaataca

SEQ ID NO: 66145 - DNA, 426 bp, Homo sapiens
caccagccagcaagaaggatacatgaacaactctagttcagcgatgatcatctcaagattttttaaaatttgagtaaggaaatcagacggtaaaatgtcctagtttttggcctattctaaaggcatttcattactaccaacaaaacgcttgcacaggggcaatgagccccctacgactgcatgcagcaggcacagcgacactgcacagtgcaacggttcaggcaagtggaaagggggaaacggcagatgccttccacacgaacactttacctatcgtcgtttttccagcattcttcacacctttccttcacgctctaataataagatggatacgctctaataataagatggctacctgactgtccggcatttgcattcagtactgcatattcctggtggtgggtacaaccccatctttgagcaaag

SEQ ID NO: 66146 - DNA, 428 bp, Homo sapiens
cccctggttcacgctttggccctggtttcgattcgagctcggttccccttgcgggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagacccgcagggggatcctctagagccgacgtaatactgga

SEQ ID NO: 66147 - DNA, 2682 bp, Homo sapiens
tctgagccttggaagggctgcaagagggaggcagagtcctttggacaaagagccacttactgctctgatctgcttgctgagtcagcaaaccggctggaaagggggcaggaaatgtcctcccaagcccccatgccagacaagctggcaggtgtccctttgggaacctggcagcttgctggtgtcccccctgaacaccgtggtcctgcggacccagaactcacaaatgtcacgcaggagccagtttgtgcaggggagcccaggctgtggctggaccatggctgcgacccccatggcctgggtgggtcctgctagtgcatcctctgctctccaggggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagacccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaaacaaaaacaacgaggcaaccacgagaaagagagaaagcgagaaacaaaaaagaagagagaaagaagacagaagaaaaaacaagggagagacagagcacaacggagagagcgagcgacgaggagagacgcaacagagagcaagcagcgagcaggcaggaggacgagaggtagacgcgggacgggagc

SEQ ID NO: 66148 - DNA, 1236 bp, Homo sapiens
ggccacaagatatgttttaacttcctactgatcttctaactttcaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagacccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaaacaaaaacaacgaggcaaccacgagaaagagagaaagcgagaaacaaaaaagaagagagaaagaagacagaagaaaaaacaagggagagacagagcacaacggagagagcgagcgacgaggagagacgcaacagagagcaagcagcgagcaggcaggaggacgagaggtagacgcgggacgggagc

SEQ ID NO: 66149 - DNA, 1541 bp, Homo sapiens
ctgctttcccagcacctgcctcactgcataggttcccacgggtctgctccagagacaccagtctcatgagaaatctccagttattaacatttgagatgctcaaaattagacaaattctataaattctgaactttgtttcctcttacacgtccaaactccatcactatctctctgtgttactctgaacaaatgacttgatgtcccaagcttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagacccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaaacaaaaacaacgaggcaaccacgagaaagagagaaagcgagaaacaaaaaagaagagagaaagaagacagaagaaaaaacaagggagagacagagcacaacggagagagcgagcgacgaggagagacgcaacagagagcaagcagcgagcaggcaggaggacgagaggtagacgcgggacgggagc

SEQ ID NO: 66150 - DNA, 2133 bp, Homo sapiens
cccaggccccagaggacaccaaggcgagcaaggcctcccaggtttctcaacctcagggtccagttctttcggactcaaccttcagggaccaccaggcccacctggcccccagggaccaaaaggtgacaaaggtgatccaggtgttccaggggctcttggcattcctagtggtccttctgaagggggatcatcaagtaccatgtacgtgtcaggcccgccaggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacatcctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagacccgcagggggatcctctagagccgacgtaatactgga

SEQ ID NO: 66151 - DNA, 1134 bp, Homo sapiens
ttgcaattgactctagaggacccccttgcgggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagacccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaaacaaaaacaacgaggcaaccacgagaaagagagaaagcgagaaacaaaaaagaagagagaaagaagacagaagaaaaaacaagggagagacagagcacaacggagagagcgagcgacgaggagagacgcaacagagagcaagcagcgagcaggcaggaggacgagaggtagacgcgggacgggagc

SEQ ID NO: 66152 - DNA, 1157 bp, Homo sapiens
cccctggttcacgctttggccctggtttcgattcgagctcggttccccttgcgggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagacccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaaacaaaaacaacgaggcaaccacgagaaagagagaaagcgagaaacaaaaaagaagagagaaagaagacagaagaaaaaacaagggagagacagagcacaacggagagagcgagcgacgaggagagacgcaacagagagcaagcagcgagcaggcaggaggacgagaggtagacgcgggacgggagc

SEQ ID NO: 66153 - DNA, 1372 bp, Homo sapiens
tactgagtcacaccgccatcctagctagcaacaattgttttagtctggaccatatatacttatagaattcagtccaagatacacaatctgaaacagcttcatggggtggactctaaccgtagttgcaatgttttagaatgagacttacttctctgctatctagatctgaactccttggcttctttacttagttcaagccccagcctaggaaagccagttacataaaagttggctcaggagtcttagagctttacctaaatatgagacccgtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagacccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaaacaaaaacaacgaggcaaccacgagaaagagagaaagcgagaaacaaaaaagaagagagaaagaagacagaagaaaaaacaagggagagacagagcacaacggagagagcgagcgacgaggagagacgcaacagagagcaagcagcgagcaggcaggaggacgagaggtagacgcgggacgggagc

SEQ ID NO: 66154 - DNA, 2251 bp, Homo sapiens
cccaggccccagaggacaccaaggcgagcaaggcctcccaggtttctcaacctcagggtccagttctttcggactcaaccttcagggaccaccaggcccacctggcccccagggaccaaaaggtgacaaaggtgatccaggtgttccaggggctcttggcattcctagtggtccttctgaagggggatcatcaagtaccatgtacgtgtcaggcccgccaggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacatcctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaaacaaaaacaacgaggcaaccacgagaaagagagaaagcgagaaacaaaaaagaagagagaaagaagacagaagaaaaaacaagggagagacagagcacaacggagagagcgagcgacgaggagagacgcaacagagagcaagcagcgagcaggcaggaggacgagaggtagacgcgggacgggagc

SEQ ID NO: 66155 - DNA, 310 bp, Homo sapiens
ggctgactgcactgtgtgtgttgttggcttccagggtccagttctttcggactcaaccttcagggaccaccaggcccacctggcccccagggaccaaaaggtgacaaaggtcagtgagggagcagtgagaaggtggtgaggagtaggggtgagcctggtgcccagagcccagagcctgaagagatggcagcaagtactcatcagtgtaaagtcttgggagagagaagaggctggaggaaggaaaggccagagggtggaagggacaaggacatggtgatatagcctctgtacaagggagctgtggtattat

SEQ ID NO: 66156 - DNA, 116 bp, Homo sapiens
tgtatgctggcaatggcggactattgggagctgactttgctggagatctggattacaatgagctggctgtgagggtgtcagagagcatgcagcgtaagtggggacatttaggcctt

SEQ ID NO: 66157 - DNA, 2862 bp, Homo sapiens
cccaggccccagaggacaccaaggcgagcaaggcctcccaggtttctcaacctcagggtccagttctttcggactcaaccttcagggaccaccaggcccacctggcccccagggaccaaaaggtgacaaaggtgatccaggtgttccaggggctcttggcattcctagtggtccttctgaagggggatcatcaagtaccatgtacgtgtcaggcccgccaggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacatcctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagacccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaaacaaaaacaacgaggcaaccacgagaaagagagaaagcgagaaacaaaaaagaagagagaaagaagacagaagaaaaaacaagggagagacagagcacaacggagagagcgagcgacgaggagagacgcaacagagagcaagcagcgagcaggcaggaggacgagaggtagacgcgggacgggagc

SEQ ID NO: 66158 - DNA, 779 bp, Homo sapiens
cccaggccccagaggacaccaaggcgagcaaggcctcccaggtttctcaacctcagggtccagttctttcggactcaaccttcagggaccaccaggcccacctggcccccagggaccaaaaggtgacaaaggtgatccaggtgttccaggggctcttggcattcctagtggtccttctgaagggggatcatcaagtaccatgtacgtgtcaggcccgccaggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggagtaagcccttccccatgccctgcacctggcaccttcctcctgtgggtctgcttttgctcccagagcctcatctcctcgtttgctgtttgctttgcccttctctggaacatgagttttaattccgaattcataataatcgggccactgggatacagtgtcaacaagggtctgtccagattcagggcggccacgctggagagacaccgagtgagccttcctgcaattgactaatgtgttcctaattataggttcttcccacctgtgcatgaaggttggcagcatctggcaggcattaggctaaagcatgttctcaaaaataaacttcctttcttacaaa

SEQ ID NO: 66159 - DNA, 1770 bp, Homo sapiens
ctccggggcgatgagggactagaggcgccctgaggcccgcctgcctcccgcgctctggccaccccggcgggaaaaggatcgggcgggcgggcggtcccacagtgcccgcctttgcgccgccccaccccctgggggcgctgccgagggggcgccagccgcccatgccgccccggcgcccagccgcgcctggcgcccgccgctgaagcgcaggacgcgccgccgcccgcgctcaccgccgtccgcgccagccgccccgagccgactgcccttctgcccccaagatgtggcacagcgtcgggctgactctgcttgtgttcgtggccacgctgctgatcgtcctgctgctgatggtgtgcggttggtattttgtatggcatctttttttatcaaaattcaagtttctccgggaactggtgggagacacaggatcccaagagggagatcatgagccttcagggtctgaaactgaagaagacacttcctcctctccacacagaatcagatccgctcgccaaaggagggcacctgctgatgaaggccacagacccctgacatagtcctgtacttgtgaaggatgaaaaggcagttgccagcttctgtcttttactgacttcgctttgaaatttactaatgactgaagaacatttgtattggattttaagtcgaattttaaaaaagatttacatgtaagccatataaaaataaagggaactgaaaccaaattggactattataaatttcatcttaaagataatcttttgtttcaccagctttctacttatacacttattccttggcttttgggcttattttcttgcactggtgcagatctggtaaacattaaaggcttgaaaaaccatattttgttagccctaaaatgtacatttttcttcccattttaacttatctgaaattgggatgcatctcattactgtcaaccaggtgatagtcatgtaacgctcctaccgtgtgcatgtgtgaatttacagcttgtcatcgtgtcatccctttaaccaacatgtgttttgttggtatcaaatgtgtcaggtttaattgacattttaaaatgtcttcaaaaagatcacactatgattcagcattgaaacgaaaagttattgtgtatgcagaaaagcatggaaacagagcagcagggcgtacatttgatattagtgaagcaaatattcgtcgctggagaaatgatcgcaattccatattttcctgcaaagcaacaacaaaatgttttacgggacctaagaaaggtaggtacccacaagtagatgaagctgtactacgtttcgtcagtgagacacgtgcaaaaggattgcctatcacacgccaagcaatgcaattgaaggcaggagaagttgccaaaaccctaggaattgatgaaacaaaattcaaagccacaagaggctggtgtgaccgattcatgcgtcgagcaggactatcattaaggcatcaaacatcgttttgtcccaagctccccactgccattaaacagaagacagtgttggagcactctttcaagaagtgctgcataaccagtactcttgacaacaccgggagagacgttctgtggaaaaatgcagacatcaatgactgtggtttgaaaagtgattcagaagagttggattcagaatatgaagttataattataacttaaccaatttatttcacacattttctttacatatgcacaagattgatgtgataaaaatctgtttaactcaaagcgctgtttcaataaatataaacattttctgtgatatg

SEQ ID NO: 66160 - DNA, 861 bp, Homo sapiens
ctccggggcgatgagggactagaggcgccctgaggcccgcctgcctcccgcgctctggccaccccggcgggaaaaggatcgggcgggcgggcggtcccacagtgcccgcctttgcgccgccccaccccctgggggcgctgccgagggggcgccagccgcccatgccgccccggcgcccagccgcgcctggcgcccgccgctgaagcgcaggacgcgccgccgcccgcgctcaccgccgtccgcgccagccgccccgagccgactgcccttctgcccccaagatgtggcacagcgtcgggctgactctgcttgtgttcgtggccacgctgctgatcgtcctgctgctgatggtgtgcggttggtattttgtatggcatctttttttatcaaaattcaagtttctccgggaactggtgggagacacaggatcccaagagggagatcatgagccttcagggtctgaaactgaagaagacacttcctcctctccacacagaatcagatccgctcgccaaaggagggcacctgctgatgaaggccacagacccctgacatagtcctgtacttgtgaaggatgaaaaggcagttgccagcttctgtcttttactgacttcgctttgaaatttactaatgactgaagaacatttgtattggattttaagtcgaattttaaaaaagatttacatgtaagccatataaaaataaagggaactgaaaccaaattggactattataaatttcatcttaaagataatcttttgtttcaccagctttctacttatacacttattccttggcttttgggcttattttcttgcactggtgcagatctggtaaacattaaaggcttgaaaaaccata

SEQ ID NO: 66161 - DNA, 1293 bp, Homo sapiens
ctccatggaaacggccaggcatccacccagccgagagcacgatggctactggggagctcggggacttgggtggctactacttcaggttcttgcctcagaaaaccttccagtctctgagctctaaggagatcaccagccggctccgccagtggtgaggaaccgaggcgcagggagagaagaggcccttggtcttcgcggctgtggaggcgcaggccgggcgtcgaggggcccgcgcgggtcggcgccattctgagtgaaccctgaggcttcctgagtgaaccccgaaccacccgggaagggcggatgctgtgggtgggatcggttatcggtgcgctctgagagggtgccagcccccagatgatttctttttcctcctctgccccaggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagagttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgagtgttcgaaagaatcctcaaaccaagaaaatacagattacctcttctgtctttaaagtttcagcttatgattctgctggtatgtgctatccttcagcaaagaatcatgaacagacattttcttactttattgtggatcctatcaggcgtcaccttcatgttttataccactgttatggtgtgggagacatgtcttaatgttctttcagattatgtacctctactattttgtatttatcatttttctatcttaatactaacttatagataaacatatactttgcaaattaattcaagaaaaatgtaaggagcctacttagagcagaagaaagcaaacaccaagatgcctttttaaaaatttgtgtggaatactaaccggggatcaaatttcatccataataaaatctatacc

SEQ ID NO: 66162 - DNA, 547 bp, Homo sapiens
ctccatggaaacggccaggcatccacccagccgagagcacgatggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgaggtaatgttgctagatcacaatatgtaaatctctagttaatagaataaattatttgcttaaccttg

SEQ ID NO: 66163 - DNA, 714 bp, Homo sapiens
ctccatggaaacggccaggcatccacccagccgagagcacgatggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagagttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgaggtaatgttgctagatcacaatatgtaaatctctagttaatagaataaattatttgcttaaccttg

SEQ ID NO: 66164 - DNA, 1231 bp, Homo sapiens
ctccatggaaacggccaggcatccacccagccgagagcacgatggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagagttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgagtgttcgaaagaatcctcaaaccaagaaaatacagattacctcttctgtctttaaagtttcagcttatgattctgctggtatgtgctatccttcagcaaagaatcatgaacagacattttcttactttattgtggatcctatcaggcgtcaccttcatgttttataccactgttatggtgtgggagacatgtcttaatgttctttcagattatgtacctctactattttgtatttatcatttttctatcttaatactaacttatagataaacatatactttgcaaattaattcaagaaaaatgtaaggagcctacttagagcagaagaaagcaaacaccaagatgcctttttaaaaatttgtgtggaatactaaccggggatcaaatttcatccataataaaatctataccaaaaaagttgtggaatttttacagaaagttacaaggaattagaaatctagttcatatttgttgcattgtgattcaagtgaatcctcaattttccatgtattttaatttataagctaattaattatggattgaaaatgtagcagaaaactaaacatgtctaccactgatcatt

SEQ ID NO: 66165 - DNA, 872 bp, Homo sapiens
ctccatggaaacggccaggcatccacccagccgagagcacgatggctactggggagctcggggacttgggtggctactacttcaggttcttgcctcagaaaaccttccagtctctgagctctaaggagatcaccagccggctccgccagtggtccatgctgggcagaatcaaggcgcaggcgttcggctttgaccagacctttcagtcctatcggaaggatgatttcgttatggcttttttcaaagacccaaatgttattcccaatttgaagttactttcagattcttctggacaatggatcatattaggaactgaagtgaaaaaaattgaagctataaatgttccttgcacacagctttcaatgtcattttttcatcggttatatgatgaagatattgtacgagacagtggacatattgttaaatgtttagattctttttgtgatccatttctcatttctgatgagttacgaagagttttgctagtggaagactcagaaaaatatgaaatattcagccaaccagatagagaagagttcctgttttgtcttttcaaacatctttgccttggtggagccctttgtcaatatgaggatgtgattagcccatatctggaaacaacaaagcttatctataaggatctggtgagtgttcgaaagaatcctcaaaccaagaaaatacagattacctcttctgtctttaaagtttcagcttatgtaagtgtgagagaacttttgcaaccaaagaatttaattactttttattaatagagttgttacaactggagttaacaatcaggacaatgttatgcctaggagaaaagacaatgttatttagagttttgttaaaattaaaagttgatagagtatgct

SEQ ID NO: 66166 - DNA, 909 bp, Homo sapiens
tattgttttaaaagtatgcctggattcctatagctacattcattcaacaactcctaaactttaatttattaactagaactcattagggaaaaatgatcccaaaagagaaggagtctaattgctcaaccaaaatttcattgaacaaatatttactgagtgcctgttatgccattctaggcacagggggatactattctcgttgagcttaacttctagtagggaacacaatagacaagtgaaaaaataaaaacaagataatttcaggtagtggtaataaagaagaaaataaaatagggtaatgtgatgagaggaataggctagaagtggaagtggcttcagattgggtggtcagggaagactcctctgaagataacttcatttgctaggagacctaaatgacaagaaggacccacctataaaaagacctgagggaagaaagagctttctaggctgaggaaagagcccaatgtgtttgtggattagagttaaagccctgagtgactaaaacatcaggattgagaagattgttagagaaggtcagggaggtatgctgaggccatggtggtcatgatgaaaaggttgattttactcagatagcaatggaggccactgaagaattcctttcttgtctctcatgtgggtctcgatgtataagcctcttcacaacttggaaaaattaattgtaaaggctgctaattcctttttaaattttttaatttactatttgaataggtaatatatttacatggttcaaaattcagaaagtattaagaggaatacagtgggacttcttcccactcaggtgtacccagtttcctcccatgggagtaaccagcatccctagagccttgtgtcttttgggagatattctatatgttaaaacaaatgtatattttctattaaaaaatg

SEQ ID NO: 66167 - DNA, 306 bp, Homo sapiens
  misc_feature (101)..(102): n is a, c, g, or t
cagacagcaaaaattttcaactgatgaaatttctcttccttccaaaagtaagtaaaaaaacagcaaccaagaaacaacaacaacaaaaataaacaaaaaannctgtcttaaatatatttttaaagaattacctggaaatattaaaaaattatatttctaatcagtgaaacaaaaaatagcaatggagaaagatacaaagatgtgaaatgaaatctaaaaaggtcagaaaagagaagaaaaagaaaaacaaactcagcagcaaagcatcagccattaggtagctacagaagaatagattctaatgag

SEQ ID NO: 66168 - DNA, 434 bp, Homo sapiens
aagtcaattttccttggtcaaattatgcatatcaaaatgttaaatatacttttcttccatcaattttcagtcaatgataaattttaccacgtgcagttttaaccattatcagtttttgctatagactgtttgtgtccccccagattcctgttttgaaacctgtcccccagtatgatggtatttggaggtttgacctttgggaggtgataaggttgtgagggtagagccctcatgaatggcatcagtgcccttacaaaacaagccacagagagctccctttctgccttctgccatctgaggacacagtgagaagacagctatctgtgaaccagggggttggccctcaccagataccaaatcttctgggactttgagctaggacatcccagcttccagaactgtgaggaataaatttcagttattgatatgtcatc

SEQ ID NO: 66169 - DNA, 950 bp, Homo sapiens
aagaatttcccgattctcttccacgtgtggacagattggcacatatgtgtgtgtgcaaattgtacttgcagtggctgcctgggaaatgaaatttctgcaccttgccagagcatgttttccctctaaagagaggcagctcataattagtaatgctaatgtcggggtgagatgcaatagataatctaacaccagcaatgatgcccagagcatttatctttgatgctgggaatgcgttcattttctttatcttgccattactgtacctctattgggaaatttactctctcttcatagataggatcagatccagtacatatttataaaaccacacttacatttaaatacaggcctttcccatttcacagtgtttctagctcccctttccaatacatctctctctctttttctctctctctctctctctctctcacacacacacacacacacacacacacagccaaatcagacaccaatataaactgtagagttaacattctttttccaccctcacactttttttagctccgatctgtgttcaatttctgcctgagagagtgatatattcatatatttaggtatagttagaaaaagcaaaatggtaacaatagaatcttgatgggattgatctcctgcagcaaggagcaacagaaaaaaaaaaaaatggaatcaagaacccaggtgctttttataggttaattgtgcagggttatcatgtatctctttaaaatcaccatcttgattctgagctttggttctacacattagaattgttgcctgggcctggatttttccccttgcatgttgcgtgtggtagtccagcacatttgctgattgcaaatatacttgtctcttctcatgggcattactagtactcaggaaatcattgatgtggggtaaaatgagaaaaggattagttttattttggacagataaacaacatgtcattttac

SEQ ID NO: 66170 - DNA, 6232 bp, Homo sapiens
  misc_feature (1839)..(1839): n is a, c, g, or t
  misc_feature (1925)..(1925): n is a, c, g, or t
  misc_feature (1946)..(1946): n is a, c, g, or t
gcggagaggcggctgcggagcgctcgggctgctgctgctgctgctgggcgccgcgtgcctgataccgcggagcgcgcaggtgaggcggctggcgcgctgccccgccacttgcagctgtaccaaggagtctatcatctgcgtgggctcttcctgggtgcccaggatcgtgccgggcgacatcagctccctgagcctggtaaatgggacgttttcagaaatcaaggaccgaatgttttcccatctgccttctctgcagctgctattgctgaattctaactcattcacgatcatccgggatgatgcttttgctggactttttcatcttgaatacctgttcattgaagggaacaaaatagaaaccatttcaagaaatgcctttcgtggcctccgtgacctgactcacctttctttggccaataaccacataaaagcactaccaagggatgtcttcagtgatttagactctctgattgaactagatttgaggggtaataaatttgaatgtgactgcaaagccaagtggctatacctgtggttgaagatgacaaattccaccgtttctgatgtgctgtgtattggtccaccagagtatcaggaaaagaagctaaatgacgtgaccagctttgactatgaatgcacaactacagattttgttgttcatcagactttaccctaccagtcggtttcagtggatacgttcaactccaagaacgatgtgtacgtggccatcgcgcagcccagcatggagaactgcatggtgctggagtgggaccacattgaaatgaatttccggagctatgacaacattacaggtcagtccatcgtgggctgtaaggccattctcatcgatgatcaggtctttgtggtggtagcccagctcttcggtggctctcacatttacaaatacgacgagagttggaccaaatttgtcaaattccaagacatagaggtctctcgcatttccaagcccaatgacatcgagctgtttcagatcgacgacgagacgttctttgtcatcgcagacagctcaaaggctggtctgtccacagtttataaatggaacagcaaaggattctattcttaccagtcactgcacgagtggttcagggacacggatgcggagtttgttgatatcgatggaaaatcgcatctcatcctgtccagccgctcccaggtccccatcatcctccagtggaataaaagctctaagaagtttgtcccccatggtgacatccccaacatggaggacgtactggctgtgaagagcttccgaatgcaaaataccctctacctttcccttacccgcttcatcggggactcccgggtcatgaggtggaacagtaagcagtttgtggagatccaagctcttccatcccggggggccatgaccctgcagcccttttcttttaaagataatcactacctggccctggggagtgactatacattctctcagatataccagtgggataaagagaagcagctattcaaaaagtttaaggagatttacgtgcaggcgcctcgttcattcacagctgtctccaccgacaggagagatttcttttttgcatccagtttcaaagggaaaacaaagatttttgaacatataattgttgacttaagtttgtgaaggtgtggtgggtgaaactaagagaaatgtagcattagctctcacaaaagaggaccaagaaaaatcaacaaacaaatcaaagccaggctcagagctctgaaattaaaaagcactgaaatagttagatgttttcaaacttttagaactcacattttaatcagggattgcatttattggctaactgcatgacatgcccattctaccatttnaaaaaaaatcttaaagcctgtaatttctgagaaaagagtacagcatttactcttatcatctagaaatgtaatatgcttcccccccnctttttgatgaggaagaaganaattggataagatgggacagcacttataatgaaataaaaaaaaactttgagcccctctcattccactttagcaatctttttggtaagaactcttaaagccaaaagtctgctgaaaagatttgctgattattagtttaaaaatcttgtaacactcagcagtgctattttgagtcatcccagtttcctgaaagtaatgcccagtcttcctgaatcctccttaatagcagaaccttggtgattttgttggctcatatgaatgcttgtcatggatatgttaacaatttagtgtttgacattgcttcctctgccacaaagacaatactctggtgacacatgtctagacccagcacaggctgtaggcccaggagtgactcaaaggagtttttccctctttcttacggttcaaaggtgaccctggtggtggccagagcagtaatgcttgtttgatgctcttcatggctcatctgcttctcagaacccacccgttgagtttgtgggtaaccagcaggcaggccaaagactggtgcttttcatttcatcctttagagggatgaaacagttatttccgtctgatgagcattcggtagaatttttgaagtgagattttatgaagtcaaaggggactttacacagatctcgacctgctttgaaacctagaggtggccctttgatttgtgcgtgtccttgccctctggacaacttaatatttcaagtaatcgaataccaacttccctgccagcccacctgccttccgccccgcttgtgtaacagtcctgttttgttgagttgctgctattgcactgccagtgcagcccacaccaaatcacaacccaagatactcagataggaagactccttcctctcccagtactttaccaaaggaacccccgccaggacccacatggggccacgtgttggcagtggaatcagcctgtgcaggctggggatctcaggctgatcagtaggggccagctttggagccagccaagctgaatcccacactccaggtctgtgctcaagagaccagatggtgtatttccaaatgggcctctctggtatgggcaataggcaagctcctggggtctggttatgtggaagattcttagtggatgttccgcctggttagctggttctcttcagagaatataaagtgaatgcctttaggggtagctctgaaagagaaacccaacaacttcattcctagccatgaaagtagcacgatcatattgtactgtattgttattgtaaaatgactatttgccatgtcatgagtaggtagatgttttgccacaaatatgaatgtgtttgttgtttcctgactttaagcaatgaagattgagacaataaatagcactcagagaatgaagcattgatgttacatcagcactcttgggtacattctgggactgtaggctgaggcttctagcctcagaaaccacggattttaatgaacgaactcacccacgcatagtagtgttgttacttgaaacttctgcaaaataccaagcaaacaggagaaaagtggtttgttttcatttttaagtgcaaattacttttcttctgcacttttttttccctcttggtttctttgaacaggctacaaatgcccaggtccccccattggaggctgaaagggaaagagctttgccattcctccagtcctaaagatggcaagctattctttctgttgcatggaaccactcagataaacctgggcagaaaaatgggtacttggcaaactgtaggagatatttagacagtcccagcaactatgccagatcaaagtgatgttcccaattccagccacctgtagagatggcaaggtggcatcttttcacagtgttgctactgcagagaggtatcacattcccagctgcccctctgagggtaaatgagcgactgaccccctgcactcactattctgctcacattgccagattctgggaaaccaggaaacacaggatgctgggcttaggatggggagagctgttgagtccagatggggaattaggaggtgaaagaacgatctaaacaggtgatgggtggggtgtgagaagggggtgacccactcaactgcaatcaggttttccttttttataatgttattttatacaagactaaagcctgtagtctacagagcgcctgtgctgtggaaggagatatttgttctggccaacttactaaaggagcatagatgttcttggcacggggtggtgatatctttgcttcattaatcttactgctccatcccaagaatccctgaagttttaaacaacttctgcaagaagcattcttccagtagtaatgtaaaacaaaaaaccaaccaagcaacagcaaaaatgcaaagcagagaaatatgtggaccgtccccagtggagatcagcttgaaggagggggtggatctttcttctactttccctcccatcacccactgggtggtcgtctgctcagcttatttcttctttatgaactttgtggcgaggctcctggactgatccctctgtgcggccatgtggctttaaggcctttccttaaagggggcttgtccccatactccatggggtcgggaatgggtctattatcaagactctaaaaataactcttagacatgaagagcactgtgttattggacagtggctgataaggccaccttacatttagcaaagctttatatttttccaatgcacattagtactcacctcatttgttcataaatagctctgaagtttattgcagggcaggtattattctaatttcagagagaaggaaatagacatgaaaactatatgaattgcctgccatggttatccaatagggactggcaaagcaataactttccctctgatcagcagacattgtattttctttctaagacaccctgctatactctcccagagaaagactttcatttctagcatgattttgaatttggcagcaccttgagataaagtaaaaagtgcaataaaatatgcatagccagaagaaaaatcatactgaatagacaccattcaatcaactggtccatttaacaattaacaaacatgcaattgcatgccccactctttttacattcaaggccccactcttgaaagtggtccagaaattttggatagttttctgttgtactaaggaggatatctagctggtctggttgtttctccccctgcatagctatggggaggatgttgaggttgagacacatctggttcttgtcacattgtccaccagataaacaagaagagatctgtgaaggaaaaattcaaaacctgaatgcacgagtggtgatgaattgctctcggccgtcatcagccttcaggaagcacactggaaatggcagagttgcattttttcttccccatggagtgagagtctgtgtatttttaggaaagaaatcagcatgggatgccagaggtttggcggtcaggagtgctcatgatggaaatttctctggcctggggtataatgaaggtgagatgaagatctgcaggaggggagtctatttgcatgccacctaaagaaaacctcttaagctggcttcctgattcttctgcagaggtatcagcctctccttcgcagctgcggaaggaagttctttaattaggcagtggccaaagattctgttcaacagcttcctggagtggaatacaataatctagttgtatgcaatgatgcaattagaaagtggtccggatttgggtggcaatggaaggggaatggcaaagtggggcagatggctctggaggaaacttgggaaagtaaaaacaaactgaaagaaaaggaaaaaaggatgatgatttcttttgcctcagccaggcaagcagagggtagaatgaccaggaagattaacaacatctcaattattaatgaagagagccaactgtaatgctcattcaaataagaagcatattgtaaagctactgagattgaaaccaagttattattatccttactgtattccattgcttgtatcaaaatctactttttttctagtaggaaactatgcattccctatcagtccctttgattatcaggaatgtataagaattgtgataaaataggccaatatgctatttggtaccatttgtatgtattttaagtgcataacctaggtaaaataagaatagtttctatgtgtaaagaagcaagttttacagtatgcagactacagtggatgtattttaggctgtatacatatttagctctttttggtaaatagggtatacaaactatatgcctcttaattcaatatattcggtaagcctatgaataaaaagtggttcatgcct

SEQ ID NO: 66171 - DNA, 3323 bp, Homo sapiens
  misc_feature (1839)..(1839): n is a, c, g, or t
  misc_feature (1925)..(1925): n is a, c, g, or t
  misc_feature (1946)..(1946): n is a, c, g, or t
gcggagaggcggctgcggagcgctcgggctgctgctgctgctgctgggcgccgcgtgcctgataccgcggagcgcgcaggtgaggcggctggcgcgctgccccgccacttgcagctgtaccaaggagtctatcatctgcgtgggctcttcctgggtgcccaggatcgtgccgggcgacatcagctccctgagcctggtaaatgggacgttttcagaaatcaaggaccgaatgttttcccatctgccttctctgcagctgctattgctgaattctaactcattcacgatcatccgggatgatgcttttgctggactttttcatcttgaatacctgttcattgaagggaacaaaatagaaaccatttcaagaaatgcctttcgtggcctccgtgacctgactcacctttctttggccaataaccacataaaagcactaccaagggatgtcttcagtgatttagactctctgattgaactagatttgaggggtaataaatttgaatgtgactgcaaagccaagtggctatacctgtggttgaagatgacaaattccaccgtttctgatgtgctgtgtattggtccaccagagtatcaggaaaagaagctaaatgacgtgaccagctttgactatgaatgcacaactacagattttgttgttcatcagactttaccctaccagtcggtttcagtggatacgttcaactccaagaacgatgtgtacgtggccatcgcgcagcccagcatggagaactgcatggtgctggagtgggaccacattgaaatgaatttccggagctatgacaacattacaggtcagtccatcgtgggctgtaaggccattctcatcgatgatcaggtctttgtggtggtagcccagctcttcggtggctctcacatttacaaatacgacgagagttggaccaaatttgtcaaattccaagacatagaggtctctcgcatttccaagcccaatgacatcgagctgtttcagatcgacgacgagacgttctttgtcatcgcagacagctcaaaggctggtctgtccacagtttataaatggaacagcaaaggattctattcttaccagtcactgcacgagtggttcagggacacggatgcggagtttgttgatatcgatggaaaatcgcatctcatcctgtccagccgctcccaggtccccatcatcctccagtggaataaaagctctaagaagtttgtcccccatggtgacatccccaacatggaggacgtactggctgtgaagagcttccgaatgcaaaataccctctacctttcccttacccgcttcatcggggactcccgggtcatgaggtggaacagtaagcagtttgtggagatccaagctcttccatcccggggggccatgaccctgcagcccttttcttttaaagataatcactacctggccctggggagtgactatacattctctcagatataccagtgggataaagagaagcagctattcaaaaagtttaaggagatttacgtgcaggcgcctcgttcattcacagctgtctccaccgacaggagagatttcttttttgcatccagtttcaaagggaaaacaaagatttttgaacatataattgttgacttaagtttgtgaaggtgtggtgggtgaaactaagagaaatgtagcattagctctcacaaaagaggaccaagaaaaatcaacaaacaaatcaaagccaggctcagagctctgaaattaaaaagcactgaaatagttagatgttttcaaacttttagaactcacattttaatcagggattgcatttattggctaactgcatgacatgcccattctaccatttnaaaaaaaatcttaaagcctgtaatttctgagaaaagagtacagcatttactcttatcatctagaaatgtaatatgcttcccccccnctttttgatgaggaagaaganaattggataagatgggacagcacttataatgaaataaaaaaaaactttgagcccctctcattccactttagcaatctttttggtaagaactcttaaagccaaaagtctgctgaaaagatttgctgattattagtttaaaaatcttgtaacactcagcagtgctattttgagtcatcccagtttcctgaaagtaatgcccagtcttcctgaatcctccttaatagcagaaccttggtgattttgttggctcatatgaatgcttgtcatggatatgttaacaatttagtgtttgacattgcttcctctgccacaaagacaatactctggtgacacatgtctagacccagcacaggctgtaggcccaggagtgactcaaaggagtttttccctctttcttacggttcaaaggtgaccctggtggtggccagagcagtaatgcttgtttgatgctcttcatggctcatctgcttctcagaacccacccgttgagtttgtgggtaaccagcaggcaggccaaagactggtgcttttcatttcatcctttagagggatgaaacagttatttccgtctgatgagcattcggtagaatttttgaagtgagattttatgaagtcaaaggggactttacacagatctcgacctgctttgaaacctagaggtggccctttgatttgtgcgtgtccttgccctctggacaacttaatatttcaagtaatcgaataccaacttccctgccagcccacctgccttccgccccgcttgtgtaacagtcctgttttgttgagttgctgctattgcactgccagtgcagcccacaccaaatcacaacccaagatactcagataggaagactccttcctctcccagtactttaccaaaggaacccccgccaggacccacatggggccacgtgttggcagtggaatcagcctgtgcaggctggggatctcaggctgatcagtaggggccagctttggagccagccaagctgaatcccacactccaggtctgtgctcaagagaccagatggtgtatttccaaatgggcctctctggtatgggcaataggcaagctcctggggtctggttatgtggaagattcttagtggatgttccgcctggttagctggttctcttcagagaatataaagtgaatgcctttaggggtagctctgaaagagaaacccaacaacttcattcctagccatgaaagtagcacgatcatattgtactgtattgttattgtaaaatgactatttgccatgtcatgagtaggtagatgttttgccacaaatatgaatgtgtttgttgtttcctgactttaagcaatgaagattgagacaataaatagcactcagagaatgaagcattgatgtt

SEQ ID NO: 66172 - DNA, 1705 bp, Homo sapiens
gcggagaggcggctgcggagcgctcgggctgctgctgctgctgctgggcgccgcgtgcctgataccgcggagcgcgcaggtgaggcggctggcgcgctgccccgccacttgcagctgtaccaaggagtctatcatctgcgtgggctcttcctgggtgcccaggatcgtgccgggcgacatcagctccctgagcctggtaaatgggacgttttcagaaatcaaggaccgaatgttttcccatctgccttctctgcagctgctattgctgaattctaactcattcacgatcatccgggatgatgcttttgctggactttttcatcttgaatacctgttcattgaagggaacaaaatagaaaccatttcaagaaatgcctttcgtggcctccgtgacctgactcacctttctttggccaataaccacataaaagcactaccaagggatgtcttcagtgatttagactctctgattgaactagatttgaggggtaataaatttgaatgtgactgcaaagccaagtggctatacctgtggttgaagatgacaaattccaccgtttctgatgtgctgtgtattggtccaccagagtatcaggaaaagaagctaaatgacgtgaccagctttgactatgaatgcacaactacagataaacaagaagagatctgtgaaggaaaaattcaaaacctgaatgcacgagtggtgatgaattgctctcggccgtcatcagccttcaggaagcacactggaaatggcagagttgcattttttcttccccatggagtgagagtctgtgtatttttaggaaagaaatcagcatgggatgccagaggtttggcggtcaggagtgctcatgatggaaatttctctggcctggggtataatgaaggtgagatgaagatctgcaggaggggagtctatttgcatgccacctaaagaaaacctcttaagctggcttcctgattcttctgcagaggtatcagcctctccttcgcagctgcggaaggaagttctttaattaggcagtggccaaagattctgttcaacagcttcctggagtggaatacaataatctagttgtatgcaatgatgcaattagaaagtggtccggatttgggtggcaatggaaggggaatggcaaagtggggcagatggctctggaggaaacttgggaaagtaaaaacaaactgaaagaaaaggaaaaaaggatgatgatttcttttgcctcagccaggcaagcagagggtagaatgaccaggaagattaacaacatctcaattattaatgaagagagccaactgtaatgctcattcaaataagaagcatattgtaaagctactgagattgaaaccaagttattattatccttactgtattccattgcttgtatcaaaatctactttttttctagtaggaaactatgcattccctatcagtccctttgattatcaggaatgtataagaattgtgataaaataggccaatatgctatttggtaccatttgtatgtattttaagtgcataacctaggtaaaataagaatagtttctatgtgtaaagaagcaagttttacagtatgcagactacagtggatgtattttaggctgtatacatatttagctctttttggtaaatagggtatacaaactatatgcctcttaattcaatatattcggtaagcctatgaataaaaagtggttcatgcct

SEQ ID NO: 66173 - DNA, 793 bp, Homo sapiens
gggcatgctgggggtgctagataccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgactccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaa

SEQ ID NO: 66174 - DNA, 497 bp, Homo sapiens
aggggggggaaactaatagcgcaggacgaggcgggtgttaatcggcagaggccaccgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaa

SEQ ID NO: 66175 - DNA, 478 bp, Homo sapiens
ccgggggggaaaaaaaactacggctaggtgcgaggctggtggcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaa

SEQ ID NO: 66176 - DNA, 586 bp, Homo sapiens
cccgggctgcaggaattcggcacgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaaaagaacatgaaagatacaagaaggcagagataaagagacagaagatgccagagggatggaggacagtgccctgacagggagtatgaatgaatggagggggacctaggtgcctg

SEQ ID NO: 66177 - DNA, 214 bp, Homo sapiens
ttcggcacgaggctgctggttctgcccctgctgcaggggctgcagagcctggggcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaa

SEQ ID NO: 66178 - DNA, 131 bp, Homo sapiens
cagctcaagggcccctgggtgggagcataggaggagtctgaagagtcagatgatgacatgggatttggcctttttgattaaattcctgctcccctgcaaataaagcctttttacacatctcaaaaaaaaaa

SEQ ID NO: 66179 - DNA, 244 bp, Homo sapiens
tactactactaaattcgcggccgcgtcgacggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaaaagtcgacgcggccgcgaat

SEQ ID NO: 66180 - DNA, 1061 bp, Homo sapiens
gggcatgctgggggtgctagataccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgactccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaaaaaaaagaaaaaaaaaaaaaaaaaaaaaaaataaaaaaaaaaaaaacaaaaagaaaaaaaagacaaaaaacaggaagaaacacacgaaagaaagaaacgcgaagaatatcgcaggcgagcaaaaacacacacgagacggagaagaacagaaggggaaagacagccgaaaacaagtgaggcgacacgcacgagagaaagcagaggaaggggcgacaccacacacagaaaggggggggaaggaacggggaagagaaacgagagacggaaa

SEQ ID NO: 66181 - DNA, 1095 bp, Homo sapiens
gggcatgctgggggtgctagataccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgactccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaaaaacccaagatgacaaagaaaagaaggaacaatggtcgtgccaaaaaaggccgcggcccacgtcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacaccccc

SEQ ID NO: 66182 - DNA, 577 bp, Homo sapiens
agatgtgtaaaaaggctttatttgcaggggagcaggaatttaatcaaaaaggccaaatcccatgtcatcatctgactcttcagactcctccttcttctcatctttcttctcctctgctgcagcaggggcagaaccagcagcaggggctgagagcctggggcagcagagacggctacagccccaccagcaggtacactggcaagcttgccaataccctgggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaa

SEQ ID NO: 66183 - DNA, 473 bp, Homo sapiens
cccgggctgcaggaattcggcacgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaa

SEQ ID NO: 66184 - DNA, 691 bp, Homo sapiens
aggggggggaaactaatagcgcaggacgaggcgggtgttaatcggcagaggccaccgaggtcgcacgcgtgagacttctccgccgcagacgccgccgcgtgagtgtggtgaccgggcccggggtgccggctggggacgcggagtccgtggggatgcggggtgggcggcggggtatttttgggacggaggcctacgggccgagccacgcgcggcctcgcccggcggccccgggatgggccggcaggaggccgccggggtaactccgccgtcgcgtcctctccgcccgcctcaggatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaa

SEQ ID NO: 66185 - DNA, 765 bp, Homo sapiens
aggggggggaaactaatagcgcaggacgaggcgggtgttaatcggcagaggccaccgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaaaaaaaagaaaaaaaaaaaaaaaaaaaaaaaataaaaaaaaaaaaaacaaaaagaaaaaaaagacaaaaaacaggaagaaacacacgaaagaaagaaacgcgaagaatatcgcaggcgagcaaaaacacacacgagacggagaagaacagaaggggaaagacagccgaaaacaagtgaggcgacacgcacgagagaaagcagaggaaggggcgacaccacacacagaaaggggggggaaggaacggggaagagaaacgagagacggaaa

SEQ ID NO: 66186 - DNA, 906 bp, Homo sapiens
gggcatgctgggggtgctagataccgaaggcagatgccgtccctttggactcgcttcgtccaacgcccccacgagtttcggtggcccttcgccccacgctataagagcagtcacttccggaactgctgcccttcgcctttgccgcgaaaagtgcctgacgggggctgggaagggggagggggaaggagtcaacgactccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaaaagaacatgaaagatacaagaaggcagagataaagagacagaagatgccagagggatggaggacagtgccctgacagggagtatgaatgaatggagggggacctaggtgcctg

SEQ ID NO: 66187 - DNA, 721 bp, Homo sapiens
aggggggggaaactaatagcgcaggacgaggcgggtgttaatcggcagaggccaccgaggtcgcacgcgtgagacttctccgccgcagacgccgccgcgatgcgctacgtcgcctcctacctgctggctgccctagggggcaactcctcccccagcgccaaggacatcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatctcaaaaaaaaaaatctctcaaaaaacaaaaaacaaaacaaacaaacaacaacaacacaaaaaaaaaaaaaaagacccccgggggcctcattgtccggggggcgggaagaaaaggggagatagaaagggccacggggccaagggggctaccgggcccacgtttctcgtgcacagggggggaactcccggggcccccaaagggggggcgtatatggccgaacgcagggaacccgcatg

SEQ ID NO: 66188 - DNA, 445 bp, Homo sapiens
tccctatttaacaaaaaacgtgggtcacactagccagtgtcttaccctaatcatgtggagtaaaacaggggttaactagcttccagaattcctggatgaatcactgcccacagcccccactgtgttcctggccccaggctggtccaggggaggaaacctgacctataggagatcatctgcctactggccagtcacggatgtgtcatacagggcactgtccactgagacatgactcagaccataaattctgttctcagaatttagaattgggaaaccaagctgccggttggtgagggtcaccagtagcaccaggtcaggatgtggggagtaatgagaccatggccattgccactatgaggaatgacagactaggtgagaaaaggaggatacagcagactccacaagggagaaaaaatgagaaaggccacggggccccagatagggg

SEQ ID NO: 66189 - DNA, 2836 bp, Homo sapiens
cctccatcctccccattccctccggttccgggctctcccttcgctccaagcctcaggccaccggcttggatggacgctccgaggctacccgtgcgtccaggggtcttgcttccgaagttggtcctgctctttgtctacgcagatgattgccttgctcagtgtggcaaagattgcaaatcttactgctgtgatggaaccacgccctactgttgctcctactacgcttatattgggaatatcctctcgggcactgcaattgcgggcattgtttttggaatagtatttatcatgggggtcattgctgggattgccatatgcatctgcatgtgcatgaagaaccacagggcgacccgcgtgggcatcctcaggacgactcacatcaacaccgtctcctcctatcctggaccaccaccctacggtcacgaccacgagatggaatactgtgcagacttgcctcctccatactcccccaccccacagggtccagcacagcgttctccaccccctccttatcctggaaacgcaaggaaataatctatctcccagaacagaacatgtgccaatgggcgatcttgcctggaataaaatgcctctactcagaaacaggcaggaaagaattgctccaaggaatactttttggggtcagataatgtgtcaggtggaatatccctgctaggagatataggatttctactctgctcaaagctgaccccatctggagtattaatgtttggttctatggaaccacattttaagagatctgctgatccacctaagcacattcagggaagagtaatgtaattgacaaaatatctgataatcatgttgtttaagggctaggtgaagaaagtttcagtattgatcctggaaaaaaagaagatctaagtaggatgggagaatgatttggcccacacaaggaagcaactttattctatatagctttaaaagtcagaactagaattgttcattctttcattcatcaataaatgtattttgagtgcctaagagtttactatgtgcctagcactgtttgaggtcctgatggaagttacaggatgggtactctggttttagtacaagaaagagcaatgactagattgctttgtgaagctcttggtagagacacgctccagaagggataacaaaatcaaatagtagatgggttcattgggcctcagaagttctgctcgtattttaggtgggtgtgaagtgaatttctatatgtccaggagtgaatacaacagaaagagttggatcttatttatttaattagggagttaaaacaagaccaaaaagactcaacagccgcttgaagccaagaactcttcaatgccagctactgccacctaaaaatcatctggctttatagtggatcagaataaaggttattctaactgtggggagaaaaaaaaaattgtatcaagttccacaggtagcagacacttcacttccaagtaaaagatgagaaatcaattattcccacaggattttaggtcagggagcaaaaatctcagaacttgaccatgaagatacacaacagactcgcaaaaataaagtgggaaatgaagttcagattcccttctgtagatttccttaaaactattatttttttcttcttcgtaaaattttgataatctgttctcttaaaaaagttaatgacacaattaagatactgacatcaaattgttgccttttaccaaaatgcaaattttatgaagtgcctacctttatatgtataaagcatttaataaataattctaatgtgccatattttgctgtgagtgaccttaacatttatatttttatatgaattgtttcatgtatttataaaaattgtatattgaacattggaaatagatgattagatttttgtgtcattttacaattaaatctaaaatgcttaatccaatatcatcatcaaaattcagtgaaatcccaaaacagtgccaagaattttgctgaatgaaacaatcaaacaaagcattttaaggtgtaagttatagtacctgtacttgcagataagaagcttactatatcattattataagtagcatatattactttcaaatacctatattagaaagatattgatctgactgaaatataacctacctgccagtaaggtccaaaggctgaatttgttttgaatgagttccttgatctttaagcactgatgattttcttatatatgaggatgcaaagcattcaagagtttcagcctgttctggtgaggggctccctgacttacataaagttttcagtgcaattttaatagtacatatgctttaatttatttttcttctgcgtgtggtcagacccaattacactgtggctaagactctcaaagtgccagggtttctgtgatgattctgagaatgctgaatacaaatataccttatattctttaaggaaaacggaaaggaaagatcagcagaaatagggttttctcatcttcaccatcaataaacatttattgcgtacctcctatattctgcaaattttccccaaatagaagccagttcagtccacaccatctcttctttgagttgtttatggcctcccttaaggcattttacaaacccataagcctacaatagatgagtatttttactatttgtattaagtgtcataatagcatcaatgtgcacattaccagtatagactgttggagttcactgattgttttcatagatgatgcttcttggggaaaaatagtataggatgtgaaagttttgaattacggttatttaaaaactaacatttgctatggccaaagtgtttacaataagcaataaagtgaaagaacctattataacacagattaaaaaaaaaatgt

SEQ ID NO: 66190 - DNA, 1518 bp, Homo sapiens
cctccatcctccccattccctccggttccgggctctcccttcgctccaagcctcaggccaccggcttggatggacgctccgaggctacccgtgcgtccaggggtcttgcttccgaagttggtcctgctctttgtctacgcagatgattgccttgctcagtgtggcaaagattgcaaatcttactgctgtgatggaaccacgccctactgttgctcctactacgcttatattgggaatatcctctcgggcactgcaattgcgggcattgtttttggaatagtatttatcatgggggtcattgctgggattgccatatgcatctgcatgtgcatgaagaaccacagggcgacccgcgtgggcatcctcaggacgactcacatcaacaccgtctcctcctatcctggaccaccaccctacggtcacgaccacgagatggaatactgtgcagacttgcctcctccatactcccccaccccacagggtccagcacagcgttctccaccccctccttatcctggaaacgcaaggaaataatctatctcccagaacagaacatgtgccaatgggcgatcttgcctggaataaaatgcctctactcagaaacaggcaggaaagaattgctccaaggaatactttttggggtcagataatgtgtcaggtggaatatccctgctaggagatataggatttctactctgctcaaagctgaccccatctggagtattaatgtttggttctatggaaccacattttaagagatctgctgatccacctaagcacattcagggaagagtaatgtaattgacaaaatatctgataatcatgttgtttaagggctaggtgaagaaagtttcagtattgatcctggaaaaaaagaagatctaagtaggatgggagaatgatttggcccacacaaggaagcaactttattctatatagctttaaaagtcagaactagaattgttcattctttcattcatcaataaatgtattttgagtgcctaagagtttactatgtgcctagcactgtttgaggtcctgatggaagttacaggatgggtactctggttttagtacaagaaagagcaatgactagattgctttgtgaagctcttggtagagacacgctccagaagggataacaaaatcaaatagtagatgggttcattgggcctcagaagttctgctcgtattttaggtgggtgtgaagtgaatttctatatgtccaggagtgaatacaacagaaagagttggatcttatttatttaattagggagttaaaacaagaccaaaaagactcaacagccgcttgaagccaagaactcttcaatgccagctactgccacctaaaaatcatctggctttatagtggatcagaataaaggttattctaactgtggggagaaaaaaaaaattgtatcaagttccacaggtagcagacaggaaggacagagagagaagaataaggagttttaaaaacttaaatataaaaaagtagctttgattttagggggaacg

SEQ ID NO: 66191 - DNA, 2782 bp, Homo sapiens
cctccatcctccccattccctccggttccgggctctcccttcgctccaagcctcaggccaccggcttggatggacgctccgaggctacccgtgcgtccaggggtcttgcttccgaagttggtcctgctctttgtctacgcagatgattgccttgctcagtgtggcaaagattgcaaatcttactgctgtgatggaaccacgccctactgttgctcctactacgcttatattgggaatatcctctcgggcactgcaattgcgggcattgtttttggaatagtatttatcatgggggtcattgctgggattgccatatgcatctgcatgtgcatgaagaaccacagggcgacccgcgtgggcatcctcaggacgactcacatcaacaccgtctcctcctatcctggaccaccaccctacggtcacgaccacgagatggaatactgtgcagacttgcctcctccatactcccccaccccacagggtccagcacagcgttctccaccccctccttatcctggaaacgcaaggaaataatctatctcccagaacagaacatgtgccaatgggcgatcttgcctggaataaaatgcctctactcagaaacaggcaggaaagaattgctccaaggaatactttttggggtcagataatgtgtcaggtggaatatccctgctaggagatataggatttctactctgctcaaagctgaccccatctggagtattaatgtttggttctatggaaccacattttaagagatctgctgatccacctaagcacattcagggaagagtaatgtaattgacaaaatatctgataatcatgttgtttaagggctaggtgaagaaagtttcagtattgatcctggaaaaaaagaagatctaagtaggatgggagaatgatttggcccacacaaggaagcaactttattctatatagctttaaaagtcagaactagaattgttcattctttcattcatcaataaatgtattttgagtgcctaagagtttactatgtgcctagcactgtttgaggtcctgatggaagttacaggatgggtactctggttttagtacaagaaagagcaatgactagattgctttgtgaagctcttggtagagacacgctccagaagggataacaaaatcaaatagtagatgggttcattgggcctcagaagttctgctcgtattttaggtgggtgtgaagtgaatttctatatgtccaggagtgaatacaacagaaagagttggatcttatttatttaattagggagttaaaacaagaccaaaaagactcaacagccgcttgaagccaagaactcttcaatgccagctactgccacctaaaaatcatctggctttatagtggatcagaataaaggttattctaactgtggggagaaaaaaaaaattgtatcaagttccacaggtagcaggtcagggagcaaaaatctcagaacttgaccatgaagatacacaacagactcgcaaaaataaagtgggaaatgaagttcagattcccttctgtagatttccttaaaactattatttttttcttcttcgtaaaattttgataatctgttctcttaaaaaagttaatgacacaattaagatactgacatcaaattgttgccttttaccaaaatgcaaattttatgaagtgcctacctttatatgtataaagcatttaataaataattctaatgtgccatattttgctgtgagtgaccttaacatttatatttttatatgaattgtttcatgtatttataaaaattgtatattgaacattggaaatagatgattagatttttgtgtcattttacaattaaatctaaaatgcttaatccaatatcatcatcaaaattcagtgaaatcccaaaacagtgccaagaattttgctgaatgaaacaatcaaacaaagcattttaaggtgtaagttatagtacctgtacttgcagataagaagcttactatatcattattataagtagcatatattactttcaaatacctatattagaaagatattgatctgactgaaatataacctacctgccagtaaggtccaaaggctgaatttgttttgaatgagttccttgatctttaagcactgatgattttcttatatatgaggatgcaaagcattcaagagtttcagcctgttctggtgaggggctccctgacttacataaagttttcagtgcaattttaatagtacatatgctttaatttatttttcttctgcgtgtggtcagacccaattacactgtggctaagactctcaaagtgccagggtttctgtgatgattctgagaatgctgaatacaaatataccttatattctttaaggaaaacggaaaggaaagatcagcagaaatagggttttctcatcttcaccatcaataaacatttattgcgtacctcctatattctgcaaattttccccaaatagaagccagttcagtccacaccatctcttctttgagttgtttatggcctcccttaaggcattttacaaacccataagcctacaatagatgagtatttttactatttgtattaagtgtcataatagcatcaatgtgcacattaccagtatagactgttggagttcactgattgttttcatagatgatgcttcttggggaaaaatagtataggatgtgaaagttttgaattacggttatttaaaaactaacatttgctatggccaaagtgtttacaataagcaataaagtgaaagaacctattataacacagattaaaaaaaaaatgt

SEQ ID NO: 66192 - DNA, 2469 bp, Homo sapiens
gtccggcatatcgtcagtattttgttaactattaatattgtgcagtagcacacagttgttaaacctggatttgcattcttaccttgcctcatactaaccatatgaagcaggacatatcacttgcccttcatgaacctcagtttactcatgagtaaaatgggcatgtgttactaaccacttcaggttgactttgtggagctttatcatatgtgaagcacatggtacaatccttgtgaaaaagtaagcaattcagcaaatgtttgctaatagtatttattatttttagtcttaaagaaattgaaaattttcttgctttttttttccttacttccttcagtgtacacactcccatttctatctcaatttgaatatgtccagtgaaggtagaaatataatctatctccttttgaaggcaaggaggagtgaagcatttaggaatactagttttaaagatgagaagtctaattattttgattaataatcacattagcttagtcattcctcaacatagctctctctctttgcatctatatataatcctattatttacttaccaatttttatatatactcctgtttactaaaacattgacattattcatgtaggctaactgttcattatctatggcttacctatcacgtatattatgttcacaatacacatcaatggcaagtagggttctctctcaggtggtacagtagctcatatagtatctatttagagtcttggttgagaagcaaacatctgggcttattggaaataagcgtggccactgaactacgagtaatacttcatgtatgggtaatttcagtcctttggtagagtgaatagtagctatgagaaacaagttgagaataaaaatattggaaaataagcatattttgatattttattctatatgaatattcatgttaaaatgaataattttcactttcagaaattttattttaaattaaatctaacattactatagattattaaataaaatactgatcttaggggataaaaaatgtagatgacttcaaaaataataatccagatctaattgttttttgggactttagtaacctcaataactaaaattttaggtttcataaaatattttgaaaacatgaatatatagattagaaattttgcaagatgattttttactccctttattgttgtatgtattcattttatttgggttataagaccatacagcaacaagaaaaagttgtgatggtacttttagttagcatatcagcaacatcagaccattagaacatcatacagaatcaatactccccagagctcacctaagattagaatacagacatgatatgtttatgacatatctacaggcaatttgctctcctccagaaaaagttgccactaacattttattcatttctctctggccttaggtccaagcacatatgcagagagctcaagtagacggagcacacataactgaattcaccaggtttatggtatcctgggccattgagttaatagctttaattgtgaacttagagaaaatgagaagccaaggacatctcagtccttagagttataattatataaatgtatttatatatgttatataaaaatatatttatatattatgtatgttataaatatttaaataaatatgttataaatatacatgttatatatgttatatatgaatatataaatatgtatataatttagaaaacattggttccctgagcactaataacagttgcttctcattagatagtcataagctacttctcaataacagccaaaatatatagtcactttagtttataatgctaaattctgtgagctacaggacttttatttattccaagtccctggcacaaagagtgtgcttaataaacacttttaagtcaaaggaaaaatacaaatatgctgaatatattgaaccacattttcatgtgttctacacctttagtaagagtgtccttattttaaatgcagaaaacccgtttgtttgataaatataaaactatttactatttacagttttgagggactgcaacacagtgagtggggttgtaaatgtttgactttaacctggtggattttggtgctatattgccaccttgtggttactcatctaaaaatggacttttcttcaaaaacaaaaatcaaaaatagacaaaacaaagaataactgttttgcttttgtgatatatggtgcaaacataagtttgtgctgtgtgcttacacacacacacagacatacagtcacacacacacacatgcatgcacaccagaaacctgagtctgaaagtagtgactgtgcttgaaaaggagagaaatggaacatctttccaagagtaatcctttaatgccgaaagtctctcatataggaaaattagctaagtggcctgtctattattttcaaacacacaatgatatgatttcaatggttaagtaaaaatgtctttccactctttataataaagaactaataat

SEQ ID NO: 66193 - DNA, 608 bp, Homo sapiens
gttaagcctgcaggttctccaatgcatccagttatgaatcccttccctctccttgcacaaggccagttcagaaacctgactctgcactccgtagaggagaaaaccttcccattgatcccaaatgatgattgatctctcccattagagcctgctcaccccttagggaacttggaaaggagatgagaaagcaagagaaagtaaaagcaagcagagcatccctctccaccccctgcacctgccttaccacaggttttaaagaatttcctccagtctttgaacagctccagggagacagcctgagctcccgttcagtctgtagaaggttctttctctagataagtgtttcccaacctggctacacaacagaaggactcaaggaattcattaaaaacatcagtttctatgcctgaccccagagattctgatttggaacacatgcagtagctttggctttcttgtgctaaaatgttcttcccaccatctctgccaactgaactcctgaatctttaaggacaagctcaaatgctaccagcttctagaagcttccaagatttcttccagttagttctctctcaagaattccagtaaatttccagagcactttgtca

SEQ ID NO: 66194 - DNA, 315 bp, Homo sapiens
tattttttagtagagacagggtttcaccatattggcaaggctggtctcgaactcctgacctcatgatctgccctcgctggcctcccaaagtgttgggattagaggcgtgagccgccgtgccaaccataaagcattcttcatttttctattggtttctttctctacaggagctaaataagatggagagaaagtgaaatatctcaggcattaccataaaaattatatgaatcagaatatggttttatctaagcagaaaacaactcatagtaccactgtgatcaaagaaggtagaagggtcagagaaaattatagtta

SEQ ID NO: 66195 - DNA, 1556 bp, Homo sapiens
ccctttgacggcttagagcccacctcgccgaatttgaaaaggcggccccggagaggcgtgggcgccccccacacatttccagctcgcacccgggctccgaccgctcgccccgctcctctcgctgtgctcccggccggtgccgcgggttcggtccgggcgccggtgcgctcctgccggtcctcgtgcccgggactccgggtccccgcgggctgctgcgcacgatgaagctggccctgctcctgccctgggcgtgttgctgcctctgcgggtcggcgctggccaccggcttcctctatcccttctcggccgcagctctgcagcagcacggctaccccgagcccggcgccggctcccctggcagcggctacgcgagccgccggcactggtgccatcacacagtgacacggacggtgtcctgccaggtgcagaatggctcggagacggtggtccagcgcgtgtaccagagctgccggtggccggggccctgcgccaacctcgtaagttacaggactctgatcagacccacctacagagtgtcctaccgcacggtgacggtgctggagtggagatgctgccctggcttcaccgggagcaactgtgatgaggaatgcatgaactgcacccggctcagtgacatgagtgagcgactgaccacactggaggccaaggtcctcctgctagaagcagcagaacggccctccagcccggacaacgacctgccagcccccgagagcactccgccgacctggaatgaggacttcctccccgacgccatccctcttgctcaccctgtgccacgacagagaaggcccacgggcccagccgggcccccggggcagacaggaccaccagggcctgcaggcccccccgggtctaaaggtgaccgaggccagacaggagagaagggtccagcggggccgcctgggctcctggggcctccagggccccgtgggcttcctggagagatggggcgccccggccccccaggaccacccggcccagcaggcaacccaggcccctcaccaaacagcccccagggcgccctctactccctgcagccgcctacagacaaagacaatggagactcaaggctggcctctgccatcgtggacacagtgctggcaggtgtcccaggaccccggggtccccctggtccaccaggtccccctgggcctcgaggtcccccaggacccccaggaacacctggatcccagggcctggctggagagcgaggcacagtggggccgtccggtgaacctggcgtgaagggggaagaaggagagaaagccgccactgcagagggcgagggggtgcagcagctgagagaggccctgaagatcctggcagagcgagtcctcatcctggagcacatgattgggatccacgatcccctggcctccccagagggaggttctggccaggatgctgccctgagagccaacctcaagatgaagaggggtggcgcccaacccgatggggtccttgctgccctgcttgggcccgaccctggacagaagagcgtggaccaggccagcagcaggaagtgagagcccact

SEQ ID NO: 66196 - DNA, 3055 bp, Homo sapiens
  misc_feature (7)..(7): n is a, c, g, or t
tcggggnaacaacctaggctaggtgcggggctgggtgttgaagtcggccgagggtcacctgggaagagtctgcagagcctttgcccgccagcgccttcgctctttggctccctgagttagtccggttgtttgcgatcgccgcggccggggctgcgaaccgaagggctcgctccgcgccgcctgggtctctacctcatccgtaggtgtggccctgatggtgtggcaggctctggactcctaaagctctggagcgaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttgctcttcgatacttggcagaatgccgtgcaaacagagaaaagatgaaaggagaactgggtatgatgttgagcttacaaaatgttatacagaaaactacaactccaggagaaacaaaacttctggcctctgaaatctatgacattcttcagtcctccaatatggcagatggtgatagttttaatgagatgaattcacgtcgaaggaaagctcaattttttctgggaactacaaacaaacgtgccaaaacagtggttttgcatatagatggccttgatgatacgtctcggagaaatctatgtgaagaggctttgttaaaaattaaaggtgttattagctttacttttcaaatggctgttcaaaggtgtgtggtgcgaatccgttcagatttgaaagctgaggctttggcatcagcaatagcatcaaccaaggttatgaaagctcagcaagttgtgaaaagtgaaagtggagaagagatgttggtcccattccaagatactcctgtggaagttgaacagaacacagagctacctgactacctgcctgaggatgagagtcccacaaaggaacaggacaaagcggtgtcccgggtcggctcacacccagaaggtggagctagctggcttagcacagctgcaaactttttatccagatcattttattggtgacttcacttttgggctcaaggactgtgtgaaccaacaaggggccagttttccattgttgtggtgaactgtcaagtgcaatttgcaataagttatcatgaaaagtttttagattacacgatcgcatatgctgcatttcacattttattggacattttaccccactgagtggtaaaaaggacagaggctacagatggagttgctttgtttatgaaagtattttggtttgttttctttcatttaattgcctcatatttaaaaaccatgggtccactgttaaaaccacatgtgtatgtgcagctttacattttattttacgtgaagcatgtgattaggaaaactcattttcttttcaagcctcaggacctacctgaagagaagttttcttgtagctcaagttgtgcatgaattactgaatattttactgtgcttttcttcatgaagggtacatgctttgtactcttcactgaaagctgaaaacatttcttgttaccctcttttgtgcctttttattttgccaaccgtgtttatagaaaggacattactaatgacattttgcagattaaaaacattcatttgaacacagtagtcccctagaaaaacaactctacaaaaattttgcagccttattcattataattttgataaaattaacacaaaatcagtcaagaaggaaacatgtatattagtgaagtgtttttggagactgtttgaatgtgaccaaatgtggttctagttgacttcttttcactttggcttatatcaattcttgagagttaatgtgatcatgatattgcaaacaactataaatggtctctaggccttactttgtgattatacgttatctccggctagaaaaaaataatggtagtaaagaaactgacaaactgaaaataagaaaacaaaaatcaaatgcctataataccataatgccagtttggtatagagtccaactttaaaacatgaattgctcgacagagttctattcagtaggtgtttctttgtattgtcttttgtgaatttattatgaaaatgctgcgttgtgttgaatgaaaaagacccaaattactgcttatgaagaaataaagccagcattgatcacttaatcctgtttctcatgtccagccagaaaaaagaacttcagtgaaggtaagataaataaatacatacacatatgtttttttggtagataagtgctaattacatatatgtaatgctttattaaatttctgaaatatttggtaactaaaattttctttttggaaattaataaatccagatacatattaatgttgatatgagtaaaaacaaataggaagaaattgaaatttcttttcatcaacatgtagagctgctattttactatttggagaatatgatgtgaaaattggacctcaaagggtttccttgtgttttcattgtaaaataccatcatcagtgagagtcttgagttcactaacattgtcaccttctggagagagagttaatggggggcattgaggatgatatttttttacatgtgtttggtttctgattcaagtgacacgcacaaactgaaaaaaaaaaaacaaaaaaagcaacaataactttcagggcacctattgctctaaatgcataatataacttgctgccagaaccagatgtgtttaaaaaagaaaataaaaccaccttctttctgtagccattaaagcaaactttactgttctaacaaatttgtattttattttgcattgccacacatctgcttatttaaaaactacatccctttggtagtaatgtttcaggacaagtaggtattacagcttgatgtttgtgtgttctaattctaagagttctttattccagatcatatagagtagttaagacaactgtaacagcattttttgaaatacattgtaaaataataaaaggtaacataatt

SEQ ID NO: 66197 - DNA, 2183 bp, Homo sapiens
ggcggcagctgcatgctgcggtcgactctaagatccccctgcaaactttttatccagatcattttattggtgacttcacttttgggctcaaggactgtgtgaaccaacaaggggccagttttccattgttgtggtgaactgtcaagtgcaatttgcaataagttatcatgaaaagtttttagattacacgatcgcatatgctgcatttcacattttattggacattttaccccactgagtggtaaaaaggacagaggctacagatggagttgctttgtttatgaaagtattttggtttgttttctttcatttaattgcctcatatttaaaaaccatgggtccactgttaaaaccacatgtgtatgtgcagctttacattttattttacgtgaagcatgtgattaggaaaactcattttcttttcaagcctcaggacctacctgaagagaagttttcttgtagctcaagttgtgcatgaattactgaatattttactgtgcttttcttcatgaagggtacatgctttgtactcttcactgaaagctgaaaacatttcttgttaccctcttttgtgcctttttattttgccaaccgtgtttatagaaaggacattactaatgacattttgcagattaaaaacattcatttgaacacagtagtcccctagaaaaacaactctacaaaaattttgcagccttattcattataattttgataaaattaacacaaaatcagtcaagaaggaaacatgtatattagtgaagtgtttttggagactgtttgaatgtgaccaaatgtggttctagttgacttcttttcactttggcttatatcaattcttgagagttaatgtgatcatgatattgcaaacaactataaatggtctctaggccttactttgtgattatacgttatctccggctagaaaaaaataatggtagtaaagaaactgacaaactgaaaataagaaaacaaaaatcaaatgcctataataccataatgccagtttggtatagagtccaactttaaaacatgaattgctcgacagagttctattcagtaggtgtttctttgtattgtcttttgtgaatttattatgaaaatgctgcgttgtgttgaatgaaaaagacccaaattactgcttatgaagaaataaagccagcattgatcacttaatcctgtttctcatgtccagccagaaaaaagaacttcagtgaaggtaagataaataaatacatacacatatgtttttttggtagataagtgctaattacatatatgtaatgctttattaaatttctgaaatatttggtaactaaaattttctttttggaaattaataaatccagatacatattaatgttgatatgagtaaaaacaaataggaagaaattgaaatttcttttcatcaacatgtagagctgctattttactatttggagaatatgatgtgaaaattggacctcaaagggtttccttgtgttttcattgtaaaataccatcatcagtgagagtcttgagttcactaacattgtcaccttctggagagagagttaatggggggcattgaggatgatatttttttacatgtgtttggtttctgattcaagtgacacgcacaaactgaaaaaaaaaaaacaaaaaaagcaacaataactttcagggcacctattgctctaaatgcataatataacttgctgccagaaccagatgtgtttaaaaaagaaaataaaaccaccttctttctgtagccattaaagcaaactttactgttctaacaaatttgtattttattttgcattgccacacatctgcttatttaaaaactacatccctttggtagtaatgtttcaggacaagtaggtattacagcttgatgtttgtgtgttctaattctaagagttctttattccagatcatatagagtagttaagacaactgtaacagcattttttgaaatacattgtaaaataataaaaggtaacataattaaaatcgagtggatattaaaaaaatatggtataagcattattgattatttatttttaaattttattttaagttctggggtacatgtatacatatgtaacaaacctgcacgttgtgcacatgtaccctagaacttaaagtataataaaaaaatataaaaatgatataaataaacttttgttttcacttgggct

SEQ ID NO: 66198 - DNA, 808 bp, Homo sapiens
agcggccgctcgcgatctagaactagcttttcatcaacatgtagagctgctattttactatttggagaatatgatgtgaaaattggacctcaaagggtttccttgtgttttcattgtaaaataccatcatcagtgagagtcttgagttcactaacattgtcaccttctggagagagagttaatggggggcattgaggatgatatttttttacatgtgtttggtttctgattcaagtgacacgcacaaactgaaaaaaaaaaaacaaaaaaagcaacaataactttcagggcacctattgctctaaatgcataatataacttgctgccagaaccagatgtgtttaaaaaagaaaataaaaccaccttctttctgtagccattaaagcaaactttactgttctaacaaatttgtattttattttgcattgccacacatctgcttatttaaaaactacatccctttggtagtaatgtttcaggacaagtaggtattacagcttgatgtttgtgtgttctaattctaagagttctttattccagatcatatagagtagttaagacaactgtaacagcattttttgaaatacattgtaaaataataaaaggtaacataattaaaatcgagtggatattaaaaaaatatggtataagcattattgattatttatttttaaattttattttaagttctggggtacatgtatacatatgtaacaaacctgcacgttgtgcacatgtaccctagaacttaaagtataataaaaaaatataaaaatgatataaataaacttttgttttcacttgggct

SEQ ID NO: 66199 - DNA, 1027 bp, Homo sapiens
  misc_feature (7)..(7): n is a, c, g, or t
tcggggnaacaacctaggctaggtgcggggctgggtgttgaagtcggccgagggtcacctgggaagagtctgcagagcctttgcccgccagcgccttcgctctttggctccctgagttagtccggttgtttgcgatcgccgcggccggggctgcgaaccgaagggctcgctccgcgccgcctgggtctctacctcatccgtaggtgtggccctgatggtgtggcaggctctggactcctaaagctctggagcgaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttgctcttcgatacttggcagaatgccgtgcaaacagagaaaagatgaaaggagaactgggtatgatgttgagcttacaaaatgttatacagaagtaagtacaatagacagtgtctcatttatttatatacttacttatattatcactgcagcctcaacctcccaagctccagctattctcccacctcatcctcccaagtagctgggactacagacatgtgccattatacctggctaatttttaaattattttgtagagacatggtctcactatgttgcctaggctgctgtcctgggatcaagcaatccttctgcctcagcctcccaaagtgctggaattacaggcatgagccatcacatcctgcccagatagttgtgtttttttttaaatggaactaaattcttttacaggacctcagttcagaaaggatgctagagaagtgattagtcagagggatagaagcagtgattaaccaggaagaggagcgctggcttaaggatgacaacagaagcatcttccttttttttctgaaacgggtctagtatggtaatcaatag

SEQ ID NO: 66200 - DNA, 3247 bp, Homo sapiens
  misc_feature (7)..(7): n is a, c, g, or t
tcggggnaacaacctaggctaggtgcggggctgggtgttgaagtcggccgagggtcacctgggaagagtctgcagagcctttgcccgccagcgccttcgctctttggctccctgagttagtccggttgtttgcgatcgccgcggccggggctgcgaaccgaagggctcgctccgcgccgcctgggtctctacctcatccgtaggtgtggccctgatggtgtggcaggctctggactcctaaagctctggagcgaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttgctcttcgatacttggcagaatgccgtgcaaacagagaaaagatgaaaggagaactgggtatgatgttgagcttacaaaatgttatacagaaaactacaactccaggagaaacaaaacttctggcctctgaaatctatgacattcttcagtcctccaatatggcagatggtgatagttttaatgagatgaattcacgtcgaaggaaagctcaattttttctgggaactacaaacaaacgtgccaaaacagtggttttgcatatagatggccttgatgatacgtctcggagaaatctatgtgaagaggctttgttaaaaattaaaggtgttattagctttacttttcaaatggctgttcaaaggtgtgtggtgcgaatccgttcagatttgaaagctgaggctttggcatcagcaatagcatcaaccaaggttatgaaagctcagcaagttgtgaaaagtgaaagtggagaagagatgttggtcccattccaagatactcctgtggaagttgaacagaacacagagctacctgactacctgcctgaggatgagagtcccacaaaggaacaggacaaagcggtgtcccgggtcggctcacacccagaaggtggagctagctggcttagcacagctgcaaactttttatccagatcattttattggtgacttcacttttgggctcaaggactgtgtgaaccaacaaggggccagttttccattgttgtggtgaactgtcaagtgcaatttgcaataagttatcatgaaaagtttttagattacacgatcgcatatgctgcatttcacattttattggacattttaccccactgagtggtaaaaaggacagaggctacagatggagttgctttgtttatgaaagtattttggtttgttttctttcatttaattgcctcatatttaaaaaccatgggtccactgttaaaaccacatgtgtatgtgcagctttacattttattttacgtgaagcatgtgattaggaaaactcattttcttttcaagcctcaggacctacctgaagagaagttttcttgtagctcaagttgtgcatgaattactgaatattttactgtgcttttcttcatgaagggtacatgctttgtactcttcactgaaagctgaaaacatttcttgttaccctcttttgtgcctttttattttgccaaccgtgtttatagaaaggacattactaatgacattttgcagattaaaaacattcatttgaacacagtagtcccctagaaaaacaactctacaaaaattttgcagccttattcattataattttgataaaattaacacaaaatcagtcaagaaggaaacatgtatattagtgaagtgtttttggagactgtttgaatgtgaccaaatgtggttctagttgacttcttttcactttggcttatatcaattcttgagagttaatgtgatcatgatattgcaaacaactataaatggtctctaggccttactttgtgattatacgttatctccggctagaaaaaaataatggtagtaaagaaactgacaaactgaaaataagaaaacaaaaatcaaatgcctataataccataatgccagtttggtatagagtccaactttaaaacatgaattgctcgacagagttctattcagtaggtgtttctttgtattgtcttttgtgaatttattatgaaaatgctgcgttgtgttgaatgaaaaagacccaaattactgcttatgaagaaataaagccagcattgatcacttaatcctgtttctcatgtccagccagaaaaaagaacttcagtgaaggtaagataaataaatacatacacatatgtttttttggtagataagtgctaattacatatatgtaatgctttattaaatttctgaaatatttggtaactaaaattttctttttggaaattaataaatccagatacatattaatgttgatatgagtaaaaacaaataggaagaaattgaaatttcttttcatcaacatgtagagctgctattttactatttggagaatatgatgtgaaaattggacctcaaagggtttccttgtgttttcattgtaaaataccatcatcagtgagagtcttgagttcactaacattgtcaccttctggagagagagttaatggggggcattgaggatgatatttttttacatgtgtttggtttctgattcaagtgacacgcacaaactgaaaaaaaaaaaacaaaaaaagcaacaataactttcagggcacctattgctctaaatgcataatataacttgctgccagaaccagatgtgtttaaaaaagaaaataaaaccaccttctttctgtagccattaaagcaaactttactgttctaacaaatttgtattttattttgcattgccacacatctgcttatttaaaaactacatccctttggtagtaatgtttcaggacaagtaggtattacagcttgatgtttgtgtgttctaattctaagagttctttattccagatcatatagagtagttaagacaactgtaacagcattttttgaaatacattgtaaaataataaaaggtaacataattaaaatcgagtggatattaaaaaaatatggtataagcattattgattatttatttttaaattttattttaagttctggggtacatgtatacatatgtaacaaacctgcacgttgtgcacatgtaccctagaacttaaagtataataaaaaaatataaaaatgatataaataaacttttgttttcacttgggct

SEQ ID NO: 66201 - DNA, 335 bp, Homo sapiens
ctgactgacagcagataattgcctactcttcgccatgccctgtggccattatttatgtgcatgatcctagatatggtggtcattcccattttacagatgagaaaactgaggctccaaaaggttaactggtatggtcatacagctagtgtgcagcacagctgggattcaaacccaggaaccagcggtgagcaagatcggacaaagcccctgccctcagggaggtttcctggagtcctctgcgattgtgggtgaggggtgacatgtgctgtttgtctgcatgatgatttgaataaagttataactctggcaagtgcttatcaaggagagctctatgg

SEQ ID NO: 66202 - DNA, 232 bp, Homo sapiens
ttgagtatctaaatcactgtattataatcaacttcgttttctgtaaattctttcataacttagggaatcatggttgctgaagtagagaatgtcacatattgataagtaaagcaatgacctcacttgaagtcaaaagttactatatctctttcctaaatctaatatattgcttagcttaactgaaataggtcatttaaatcgcttgtcatttggcagaaagaagaatattttt

SEQ ID NO: 66203 - DNA, 363 bp, Homo sapiens
gtctctcctaagaaaatctctgagggattggaaatacttatcctgaaaggctaagggagttggtggtgtgtgggggttcaatccccaaagaacgtaaaaatcccatgtcctccacctgttgagttggaaaatgtggggctgcctaatggtctccccctcggctctcctgatgatatctgttcaagaaatgagaactatggtctattttcagtcttggtagaagattggctcagtgggactggcaaatagtggagaaatgggcacacattcacagggccaataccctgaagatccaaacgaaagaaattcttacccccacaaaataagtgaacttaatcaaaaaataaaatggaggatatgatt

SEQ ID NO: 66204 - DNA, 1038 bp, Homo sapiens
gcagttatcatagagcacagtccctcacatcacacagctgcagagatgaataaacaaagaggaaccttctcagaagtgagtctggcccaggacccaaagccgcagcaaaggaaacctaaaggcaataaaagctccatttcaggaaccgaacaggaaatattccaagtagaattaaaccttcaaaatgcttctctgaatcatcaagggattgacaaaatatatgactgccaaggtttactgccacctccagagaagctcactgccgaggtcctaggaatcatttgcattgtcctgatggccactgtgttaaaaacaatagttcttattcctttcctggagcagaacaattcttccccgaatacaagaacgcagaaagcacgtccttgtggccattgtcctgaggagtggattacatattccaacagttgttactacattggtaaggaaagaagaacttgggaagagagtttgcaggcctgtgcttcaaagaactcttctagtctgctttctatagataatgaagaagaaatgaaatttctggccagcattttaccttcctcatggattggtgtgtttcgtaacagcagtcatcatccatgggtgacaataaatggtttggctttcaaacatgagataaaagactcagatcatgctgaacgtaactgtgcaatgctacatgtacgtggacttatatcagaccagtgtggatcttcaagaatcattagacggggtttcatcatgttgaccaggctggtcttgaactcctgagctcaagaaatcaacacatcttggcctcccaagttgctgggattactgacacaagccaccgcccctgagtgctcatgtaccatttagcttgtgttttaaaaatctactttttctgccctccctatttttaactagatgatgttttaaaaattacttttccctctctatatagtttgatttaagcattagtcatttacaacaaatattaatattaaaatgcagaccgttatgattggaaaataaatcaatgaacaatataaaaaaaaaaaa

SEQ ID NO: 66205 - DNA, 843 bp, Homo sapiens
  misc_feature (756)..(756): n is a, c, g, or t
  misc_feature (797)..(797): n is a, c, g, or t
  misc_feature (839)..(839): n is a, c, g, or t
gcagttatcatagagcacagtccctcacatcacacagctgcagagatgaataaacaaagaggaaccttctcagaagtgagtctggcccaggacccaaagccgcagcaaaggaaacctaaaggcaataaaagctccatttcaggaaccgaacaggaaatattccaagtagaattaaaccttcaaaatgcttctctgaatcatcaagggattgacaaaatatatgactgccaaggtttactgccacctccagagaagctcactgccgaggtcctaggaatcatttgcattgtcctgatggccactgtgttaaaaacaatagttcttattcctttcctggagcagaacaattcttccccgaatacaagaacgcagaaagcacgtccttgtggccattgtcctgaggagtggattacatattccaacagttgttactacattggtaaggaaagaagaacttgggaagagagtttgcaggcctgtgcttcaaagaactcttctagtctgctttctatagataatgaagaagaaatgaaatttctggccagcattttaccttcctcatggattggtgtgtttcgtaacagcagtcatcatccatgggtgacaataaatggtttggctttcaaacatgagataaaagactcagatcatgctgaacgtaactgtgcaatgctacatgtacgtggacttatatcagaccagtgtggatcttcaagaatcatttaagaccggggtttcaacaatgtttggaccaangctggggccttggaactccctgggaggctccaaaggaaaanccaaacaaccaatcctttgggggggcccttccccccaaaaangggt

SEQ ID NO: 66206 - DNA, 843 bp, Homo sapiens
gcagttatcatagagcacagtccctcacatcacacagctgcagagatgaataaacaaagaggaaccttctcagaagtgagtctggcccaggacccaaagccgcagcaaaggaaacctaaaggcaataaaagctccatttcaggaaccgaacaggaaatattccaagtagaattaaaccttcaaaatgcttctctgaatcatcaagggattgacaaaatatatgactgccaaggtttactgccacctccagagaagctcactgccgaggtcctaggaatcatttgcattgtcctgatggccactgtgttaaaaacaatagttcttattcctttcctggagcagaacaattcttccccgaatacaagaacgcagaaagcacgtccttgtggccattgtcctgaggagtggattacatattccaacagttgttactacattggtaaggaaagaagaacttgggaagagagtttgcaggcctgtgcttcaaagaactcttctagtctgctttctatagataatgaagaagaaatgaaatttctggccagcattttaccttcctcatggattggtgtgtttcgtaacagcagtcatcatccatgggtgacaataaatggtttggctttcaaacatgagataaaagactcagatcatgctgaacgtaactgtgcaatgctacatgtacgtggacttatatcagaccagtgtggatcttcaagaatcattgtgagcataagctttagaattaaagcgcttgagcttgcagtgcatcagataaaattttatatttgttcaaacagaaatgatattatgattgcataagccttaaaatgaattgtgttattt

SEQ ID NO: 66207 - DNA, 227 bp, Homo sapiens
gaagcatgctgaggtgactgggactccagatctacggacttgcccaggtggtggcggggacatccactgcaatagacagtgggattccaaggtggggctgctcaggaaccagagagaggctagcaccgcaggcaacggtgcaggtgaatggactgaacgatttcatccgttcttccaaggtggggctgctcaggaaccagtgagaggctagcaccgcaggcaacggt

SEQ ID NO: 66208 - DNA, 2015 bp, Homo sapiens
aatctattataatttttttttaatttattggtgaacccgcaagacacgctttacattttcaacacatcattatttgaaccacctcctccaggatatgaaaatgtttcggatattgtaccatctttcagtgctttctctcctcaaggaatgccagagggtgatctagtgcatgttaactatgcacgaactgaagacttctttaaattggaacgggacatgaaaatcaattgctctgggaaaattgtaattgccagatataggaaagttttcagaggaaataaggttaaaaatgcccagctggcaggggccaaaggagtcattctctactcagaccctgctgactactttgctcctggggtgaagtcctatccagacggttggaatcttcctggaggtggtgtccagcgtggaaatatcctaaatctgaatggtgcaggagaccctctcacaccaggttacccagcaaatgaatacgcttataggcatggaattgcagaggctgttggtcttccaagtattcctgttcatccagttggatactatgatgcacagaagctcctagaaaaaatgggtggctcagcaccaccagatagcagctggagaggaagtctcaaagtgtcctacaatgttggacctggctttactggaaacttttctacacaaaaagtcaagatgcacatccactctaccaatgaagtgacgagaatttacaatgtgataggtactctcagaggagcagtggaaccagacagatatgtcattctgggaggtcaccgggactcatgggtgtttggtggtattgaccctcagagtggagcagctgttgttcatgaaactgtgaggagctttggaacactgaaaaaggaagggtggagacctagaagaacaattttgtttgcaagctgggatgcagaagaatttggtcttcttggttctactgagtgggcagaggataattcaagactccttcaagagcgtggcgtggcttatattaatgctgactcatctatagaaggaaactacactctgagagttgattgtacaccactgatgtacagcttggtatacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacaatatttctatgaaacatccacaggaaatgaagacatacagtttatcatttgattcacttttttctgcagtaaaaaattttacagaaattgcttccaagttcagcgagagactccaggactttgacaaaagcaacccaatattgttaagaatgatgaatgatcaactcatgtttctggaaagagcatttattgatccattagggttaccagacagacctttttataggcatgtcatctatgctccaagcagccacaacaagtatgcaggggagtcattcccaggaatttatgatgctctgtttgatattgaaagcaaagtggacccttccaaggcctggggagatgtgaagagacagatttctgttgcagccttcacagtgcaggcagctgcagagactttgagtgaagtagcctaagaggattctttagagactctgtattgaatttgtgtggtatgtcactcaaagaataataatgggtatattgataaattttaaaattggtatatttgaaataaagttgaatattatatata

SEQ ID NO: 66209 - DNA, 390 bp, Homo sapiens
tatgcaatccaggaattgcagagtgctctggtttctcttgtatatcatttgggcacctaataaacagcaaacgattttatcaacaggcatgtcatctatgctccaagcagccacaacaagtatgcaggggagtcattcccaggaatttatgatgctctgtttgatattgaaagcaaagtggacccttccaaggcctggggagatgtgaagagacagatttctgttgcagccttcacagtgcaggcagctgcagagactttgagtgaagtagcctaagaggattctttagagactctgtattgaatttgtgtggtatgtcactcaaagaataataatgggtatattgataaattttaaaattggtatatttgaaataaagttgaatattat

SEQ ID NO: 66210 - DNA, 1974 bp, Homo sapiens
agcaaatactcactaccacaaataagaacatttccaaatctgatgttctgaggatttttagagcttatagtagcaaaaagaaaagggaaattctctctgagatgtccttttttgtaggcctaatgacaaaaggttgaagataaagttctagtactcatttaagtgtaatattgaaaattgatattaccaaatctggaacaaccaatttaaaataaggaaagaaagacactgtgttttctaggttaaaaatgcccagctggcaggggccaaaggagtcattctctactcagaccctgctgactactttgctcctggggtgaagtcctatccagacggttggaatcttcctggaggtggtgtccagcgtggaaatatcctaaatctgaatggtgcaggagaccctctcacaccaggttacccagcaaatgaatacgcttataggcatggaattgcagaggctgttggtcttccaagtattcctgttcatccagttggatactatgatgcacagaagctcctagaaaaaatgggtggctcagcaccaccagatagcagctggagaggaagtctcaaagtgtcctacaatgttggacctggctttactggaaacttttctacacaaaaagtcaagatgcacatccactctaccaatgaagtgacgagaatttacaatgtgataggtactctcagaggagcagtggaaccagacagatatgtcattctgggaggtcaccgggactcatgggtgtttggtggtattgaccctcagagtggagcagctgttgttcatgaaactgtgaggagctttggaacactgaaaaaggaagggtggagacctagaagaacaattttgtttgcaagctgggatgcagaagaatttggtcttcttggttctactgagtgggcagaggataattcaagactccttcaagagcgtggcgtggcttatattaatgctgactcatctatagaaggaaactacactctgagagttgattgtacaccactgatgtacagcttggtatacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacaatatttctatgaaacatccacaggaaatgaagacatacagtttatcatttgattcacttttttctgcagtaaaaaattttacagaaattgcttccaagttcagcgagagactccaggactttgacaaaagcaacccaatattgttaagaatgatgaatgatcaactcatgtttctggaaagagcatttattgatccattagggttaccagacagacctttttataggcatgtcatctatgctccaagcagccacaacaagtatgcaggggagtcattcccaggaatttatgatgctctgtttgatattgaaagcaaagtggacccttccaaggcctggggagatgtgaagagacagatttctgttgcagccttcacagtgcaggcagctgcagagactttgagtgaagtagcctaagaggattctttagagactctgtattgaatttgtgtggtatgtcactcaaagaataataatgggtatattgataaattttaaaattggtatatttgaaataaagttgaatattatatata

SEQ ID NO: 66211 - DNA, 434 bp, Homo sapiens
aatacactttattgaagcaggtacagaactgctgtgtaattaatttcaagacacttattttctctcaaaagtgcttctaaaacaagtttccatgcttgaagcgttgagtgtcaagtatctgggagatttgcttttgtaggacggttcatttcccacttgtgccagaatgagtcattttgtgtgtaagtgtcaagcttggagaggttctaattaagtgcaaattacaatgaaattaataaatgacaccaatttttagattttaaaatgtgctttgagagaatgcaatgtgggcttagattgatggtaattctcatattttaagttgtgattcaatattatgtagcattaaaactcaattaagtaaaaaataaatgaagaatcaagtagagagaatactcatctctcagatgcctcagcttctccaatgatggctt

SEQ ID NO: 66212 - DNA, 438 bp, Homo sapiens
agtttactggtcacctgcactaacagcctgagagaaaaggacactgcatatcacagagagatgcatagatgttacactcagaaagagagtgaacaactagaagatgtggaagaaaattccaagggccaattttgaaacaaaccaggcagagacccagatgcagaatcctgcaggctgagggatgttaggaagagttagcccaccactgctgcgctgaaaccaggatgacgcaaactgggcctcaggccagtagatcaataaaccaaactccctgtcacctcagactctgcacctgttaaagccctgtaaagagccgacatgtaaggacttatactgactggatacagagaatatggagcaaatcaaacgtatttaaatagtaaattatcatattgttataaataaaaatttacattgcatttccttttagaatgttac

SEQ ID NO: 66213 - DNA, 437 bp, Homo sapiens
agtttactggtcacctgcactaacagcctgagagaaaaggacactgcatatcacagagagatgcatagatgttacactcagaaagagagtgaacaactagaagatgtggaagaaaattccaagggccaattttgaaacaaaccaggcagagacccagatgcagaatcctgcaggctgagggatgttaggaagagttagcccaccactgctgcgctgaaaccaggatgacgcaaactgggcctcaggccaggcttagaatataaactgacaccttgaagaagtgaccatcttgtaatcaacactttattctaaggataacagagataaatgatataaggatctctgtttcttaatggcattgttgagccctaaactttctactgctagatattttatcgcatgaaataaataagccttagttgcttaaaaaaatttca

SEQ ID NO: 66214 - DNA, 601 bp, Homo sapiens
agtttactggtcacctgcactaacagcctgagagaaaaggacactgcatatcacagagagatgcatagatgttacactcagaaagagagtgaacaactagaagatgtggaagaaccagtttggctctggagtcaagaattctcaaaacagctttctgaacctgaatcgcacgcagtaaagctggtgttctcctgaagccaacatttatggtatcaccttgctgatccaggcaaaatggcaaaagtgtagtgaacataaagccaggggctgagattgtggatgtcctctgtaccaagtttcttattatgaaaattccaagggccaattttgaaacaaaccaggcagagacccagatgcagaatcctgcaggctgagggatgttaggaagagttagcccaccactgctgcgctgaaaccaggatgacgcaaactgggcctcaggccaggatcaacatcttgtctagacagagaaatattgatggagatcagaaaatttattagagtatttgaaggtcttgtgggactggagagacaacgttggacacttaagtggaaaatctgacacataacagaactgagactatcattgtattttttaaaa

SEQ ID NO: 66215 - DNA, 525 bp, Homo sapiens
agtttactggtcacctgcactaacagcctgagagaaaaggacactgcatatcacagagagatgcatagatgttacactcagaaagagagtgaacaactagaagatgtggaagaaccagtttggctctggagtcaagaattctcaaaacagctttctgaacctgaatcgcacgcagtaaagctggtgttctcctgaagccaacatttatggtatcaccttgctgatccaggcaaaatggcaaaagtgtagtgaacataaagccaggggctgagattgtggatgtcctctgtaccaagtttcttattatggtaagggtagaagttcaccaggtcagtaatgtgattttgtccaaagagccatttctggagatctagcctaaacattgctcctccaactcttcccataatttgttaacaattgaataattgttctgtttaaaatagtttggatgttttatgttttctgcaactttactgttatcataacaaagacataaataaagatctaaataaagtcagaaataca

SEQ ID NO: 66216 - DNA, 648 bp, Homo sapiens
agtttactggtcacctgcactaacagcctgagagaaaaggacactgcatatcacagagagatgcatagatgttacactcagaaagagagtgaacaactagaagatgtggaagaaccagtttggctctggagtcaagaattctcaaaacagctttctgaacctgaatcgcacgcagtaaagctggtgttctcctgaagccaacatttatggtatcaccttgctgatccaggcaaaatggcaaaagtgtagtgaacataaagccaggggctgagattgtggatgtcctctgtaccaagtttcttattatgaaaattccaagggccaattttgaaacaaaccaggcagagacccagatgcagaatcctgcaggctgagggatgttaggaagagttagcccaccactgctgcgctgaaaccaggatgacgcaaactgggcctcaggccaggtgtattccttggagtataactgaaggtttacttggtaattctatgtttaactttttttggaacttctggactatcttccaaagcaacagtaccattgtacattttcaccagccacgtatgacagtcacactctctccacattcttgccaaaacttgttatcatttttcaaataaaagacagcctagtgtgtatctgaaaga

SEQ ID NO: 66217 - DNA, 445 bp, Homo sapiens
gggactacaggcatgtgccaccatgccttgctaacttttgtatttttagtagagatggggtttcccatgttggccaggctgtttttgaactcctgaagtaaagtgatccacctgccttggcctttcaaagtgttgggattacaggtgtgagcgaccgcacccagcctactttcttttatttagaactcagtttcccagcctccattacaactgggttcaagaatataacctaggctttgccagtcaggctcatccatatcaaacttaaattcaggtataagcaaccagaggaaagtggctcattatggagctccttgccttgctggtatgaattgccctaatagccaggcggctgccttagttggcagcactagcagtgacgttagtttctcagtggttgcaacatggagtttctgatgtaatagtggtattgacagagagctgc

SEQ ID NO: 66218 - DNA, 1232 bp, Homo sapiens
agcggggttgcaggtgggcgcgcgttgcctaacgaccttccgcgcggacggtgggcaggcgacggcggcgtgtggatggaggccttcgcccttggcccagcgcggcggggcaggcggcggacccgggccgccggctccctgctctctcgggccgccatcctcctctttatctccgccttcctggtgcgggtgccctcatcagttggacacttggttcgattaccaagagcttttcgcttgaccaaagattcagtgaaaatagtgggatcaacaagttttccagtgaaagcgtatgtcatgctccatcaaaagagtccacacgtgttatgtgtaacgcaacaactgcgaaatgctgaactgatagacccatcattccaatggtatgggcctaaaggaaaagttgtttcagtagaaaaccgcactgcacaaataacatccacaggaagccttgtattccaaaattttgaggagagtatgagtggaatttatacatgtttcctcgaatataaacctactgtggaagaaattgttaaacgtcttcaactaaaatatgctatatatgcttatcgtgagcctcattattattatcagttcacagctcgatatcatgcagctccctgcaatagcatttataatatttcttttgagaagaaacttcttcagattttaagcaaactgcttcttgacctttcatgtgaaatttccttacttaagtctgaatgccatcgcgttaaaatgcaaagagctggtttgcaaaatgaattgttctttgcattttcagtttcatctctagacactgaaaaaggacccaagcgatgtacagaccataactgtgaaccttacaaaagactttttaaggctaaaaatctcatagagagattttttaatcaacaagtagaaattcttggcagacgtgcagaacaattacctcaaatatactatattgaaggtactctccaaatggtttggattaatcgctgctttccaggatatggaatgaatgtccagcaacatccaaaatgtcctgagtgctgtgtgatctgcagccctggatcatataacccccgtgatggaattcattgccttcaatgcaatagcagcctggtgtatggagcaaaaacgtgcttataagccattatcttcagttattcagtggtttattaaatgcaaagtatatatttgaaatattaacataataaattattatgccaaaattaatcatattttacaaa

SEQ ID NO: 66219 - DNA, 567 bp, Homo sapiens
agcggggttgcaggtgggcgcgcgttgcctaacgaccttccgcgcggacggtgggcaggcgacggcggcgtgtggatggaggccttcgcccttggcccagcgcggcggggcaggcggcggacccgggccgccggctccctgctctctcgggccgccatcctcctctttatctccgccttcctggtgcgggtgccctcatcagttggacacttggttcgattaccaagagcttttcgcttgaccaaagattcagtgaaaatagtgggatcaacaagttttccagtgaaagcgtatgtcatgctccatcaaaagagtccacacgtgttatgtgtaacgcaacaactgcgaaatgctgaactgatagacccatcattccaatggtatgggcctaaaggaaaagttgtttcagaaaggactggaagaggtctaatgtcttaaagtttgaagaacagagaagctttttggactgtagtttaaactgcactgtacttatcattttatggatatctcaaagatagtttcccttgatttgagccaaataaatcatgtaattatgtgaaaaaaaaa

SEQ ID NO: 66220 - DNA, 1414 bp, Homo sapiens
aacatgacctttttttatcccccttcaggagagtggcttcttcccatttaaaccctggaaaatataattggctacaaatttcaagattttttcccaatttatggattaccttcaagttccatacaactggcaccatctaccaacaagagtgagcatccaggaacctcgttagaaacttttctcagtggaaattaacttatcttcattccactttaagtgtgcaagacttgcaaataaaggtcgtgtcttaaaagcggctcagatgaaactaccaatttggctgctgctgctaccgcttttaaacaattaaaatatggcttagctactgagtccaatcacaggctataatatgtgattggcctctattttccttcatgtttttggttggacacttggttcgattaccaagagcttttcgcttgaccaaagattcagtgaaaatagtgggatcaacaagttttccagtgaaagcgtatgtcatgctccatcaaaagagtccacacgtgttatgtgtaacgcaacaactgcgaaatgctgaactgatagacccatcattccaatggtatgggcctaaaggaaaagttgtttcagtagaaaaccgcactgcacaaataacatccacaggaagccttgtattccaaaattttgaggagagtatgagtggaatttatacatgtttcctcgaatataaacctactgtggaagaaattgttaaacgtcttcaactaaaatatgctatatatgcttatcgtgagcctcattattattatcagttcacagctcgatatcatgcagctccctgcaatagcatttataatatttcttttgagaagaaacttcttcagattttaagcaaactgcttcttgacctttcatgtgaaatttccttacttaagtctgaatgccatcgcgttaaaatgcaaagagctggtttgcaaaatgaattgttctttgcattttcagtttcatctctagacactgaaaaaggacccaagcgatgtacagaccataactgtgaaccttacaaaagactttttaaggctaaaaatctcatagagagattttttaatcaacaagtagaaattcttggcagacgtgcagaacaattacctcaaatatactatattgaaggtactctccaaatggtttggattaatcgctgctttccaggatatggaatgaatgtccagcaacatccaaaatgtcctgagtgctgtgtgatctgcagccctggatcatataacccccgtgatggaattcattgccttcaatgcaatagcagcctggtgtatggagcaaaaacgtgcttataagccattatcttcagttattcagtggtttattaaatgcaaagtatatatttgaaatattaacataataaattattatgccaaaattaatcatattttacaaa

SEQ ID NO: 66221 - DNA, 1298 bp, Homo sapiens
  misc_feature (1114)..(1114): n is a, c, g, or t
  misc_feature (1152)..(1152): n is a, c, g, or t
agcggggttgcaggtgggcgcgcgttgcctaacgaccttccgcgcggacggtgggcaggcgacggcggcgtgtggatggaggccttcgcccttggcccagcgcggcggggcaggcggcggacccgggccgccggctccctgctctctcgggccgccatcctcctctttatctccgccttcctggtgcgggtgccctcatcagttggacacttggttcgattaccaagagcttttcgcttgaccaaagattcagtgaaaatagtgggatcaacaagttttccagtgaaagcgtatgtcatgctccatcaaaagagtccacacgtgttatgtgtaacgcaacaactgcgaaatgctgaactgatagacccatcattccaatggtatgggcctaaaggaaaagttgtttcagtagaaaaccgcactgcacaaataacatccacaggaagccttgtattccaaaattttgaggagagtatgagtggaatttatacatgtttcctcgaatataaacctactgtggaagaaattgttaaacgtcttcaactaaaatatgctatatatgcttatcgtgagcctcattattattatcagttcacagctcgatatcatgcagctccctgcaatagcatttataatatttcttttgagaagaaacttcttcagattttaagcaaactgcttcttgacctttcatgtgaaatttccttacttaagtctgaatgccatcgcgttaaaatgcaaagagctggtttgcaaaatgaattgttctttgcattttcagtttcatctctagacactgaaaaaggacccaagcgatgtacagaccataactgtgaaccttacaaaagactttttaaggctaaaaatctcatagagagattttttaatcaacaagtagaaattcttggcagacgtgcagaacaattacctcaaatatactatattgaaggtactctccaaatggtttggattaatcgctgctttccaggatatggaatgaatgtccagcaacatccaaaatgtcctgagtgctgtgtgatctgcagccctggatcatataacccccgtgatggaattcattgccttcaatgcaaaaattttttttttttttggngaaaaaagggggggggcgccccccccccaaaagggggncccccctttagcagcctggtgtatggagcaaaaacgtgcttataagccattatcttcagttattcagtggtttattaaatgcaaagtatatatttgaaatattaacataataaattattatgccaaaattaatcatattttacaaa

SEQ ID NO: 66222 - DNA, 134 bp, Homo sapiens
tttactttaggtttttgcttcatcatgtatgctgggaaaaccttcggacttctttgagtgttccccttttttctacatacttgcattactttgaagccatatgttatgtcattcttttctatacttgaacacta

SEQ ID NO: 66223 - DNA, 294 bp, Homo sapiens
taaactagatacacacgtgccaatattttatattatattcataagcttcttagcgcagccaggtgacaactctactagaatcactatcctgacagaactctacatacaagctgtcatttttgaccacatttccagaaggaagacttaagtaccaacatgttaatttcctaataatttgctaaatttaaataaattccgtagacagagcaaattagaataataaatgagccctgtagctggaaggcaaattagaacaataaagttaataaagaagttagaaagaaaactgtaaaa

SEQ ID NO: 66224 - DNA, 883 bp, Homo sapiens
ctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagtcagactctcagttaatctttcctagatctggacaaagaaaagcctcaaagaaaacctgtttccatcaatgctgattctctacagatgcaaatctctcccacaaagacgctaacaagtgctggtaaagacctacaagataattttctgacggccctggcaatgagagaagaagacaatcgcagtggaaaactgagtgtatacaaaaatggttaaaactctgtccaagcttttcaaagaaacaacagctggaccaaccatcaaaatgtgaccaccaaggagatacgatggatgggttgagtttacttcctcactaagaagataaggggagacttcacctagaaagtgccggtttaaactgcaactaaaatagcagttttctggtataccagctagagggaaggcctctcacgcgggcggccactggctaccaaggggatcggagggagcccgaaagtttccgggggacgaccactgggccgggggaggggcgaccgaaggccagggggccccaagcaacggggcttaggacggggggcgcgaacagaaattgcaccgcccggtcaggtgggccgcacaaaggggcgggagac

SEQ ID NO: 66225 - DNA, 490 bp, Homo sapiens
ctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagtgtaagtacatttcatccaacagcttaaaatgtatacactaaatgcacaattaatattaaaaaatgtaacattaaatatctttcttaaagtaatttacaagatataaaa

SEQ ID NO: 66226 - DNA, 767 bp, Homo sapiens
ctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagttccgtgatctttattcgtgacagaaattctcatgggcaagagatatcaggatacatcgactatgcccacaggctaaagacggaagattttgaagtctactttactggaaaaaaaagacttcttccaaggcctacagatataaggcgcagccaggtgacaactctactagaatcactatcctgacagaactctacatacaagctgtcatttttgaccacatttccagaaggaagacttaagtaccaacatgttaatttcctaataatttgctaaatttaaataaattccgtagacagagcaaattagaataataaatgagccctgtagctggaaggcaaattagaacaataaagttaataaagaagttagaaagaaaactgtaaaa

SEQ ID NO: 66227 - DNA, 897 bp, Homo sapiens
ctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagttccgtgatctttattcgtgacagaaattctcatgggcaagagatatcaggatacatcgactatgcccacaggctaaagacggaagattttgaagtctactttactggaaaaaaaagacttcttccaaggcctacagatataagcttttacaactgggacgctgatattgctgttagtaattcaagtcccaactatcaagtgattgccgataatccagaaggcttacttttcagatacaaaagagacagaaaaattcttaatgtggacccaaaggcgcagccaggtgacaactctactagaatcactatcctgacagaactctacatacaagctgtcatttttgaccacatttccagaaggaagacttaagtaccaacatgttaatttcctaataatttgctaaatttaaataaattccgtagacagagcaaattagaataataaatgagccctgtagctggaaggcaaattagaacaataaagttaataaagaagttagaaagaaaactgtaaaa

SEQ ID NO: 66228 - DNA, 515 bp, Homo sapiens
ctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggatgaaaccctggcccgccagttggtggagctaggctaccgagggactggagagagagtgaaaagggaagattttgaagcaaggaaagcggctatagagattgcaagactggctgaaagagctcagcaaaagacgctaacaagtgctggtaaagacctacaagataattttctgacggccctggcaatgagagaagaagacaatcgcagtggaaaactgagtatactggaacccatcttgaatcatgctatggaccgaaagtctgtgacctccccacctaaattcatacgttgaaatcttcactccctaagtgatagtattaggaggtgagggcctttgaaggacaattacatca

SEQ ID NO: 66229 - DNA, 532 bp, Homo sapiens
gtgagaatgcattgtgtaaatgatcatagcacagtgcttttctgtacgtctcaggtcggatttcctggcagcagaccctgagacagagggtcacatgcaggaagtggatcaggcagtccttgcgggggaataaaggaggcaggaccgtgcagagggagaagttgacctgcacggtcaactttgtaggtagccccagcaaaggccccagccaatcttgggggcaccggggtggcgctgcagaattgttctgaattgaggcaaaggtttgggcccttcctacccctggatggtgcggaaggccccctgcagaaggctgatccctggagaggtagctctctttagtcaagggcagatccagaagaggcacctgtctgagagctgtggtcatgaatacttccagcagctggaggaatgaaggttttgtgctgaaagggttggagggctctgagggtgtgtgacagcacctaattacactgttcatttccagatttctacaatttctgcagtaacatttattttataataaaaaaag

SEQ ID NO: 66230 - DNA, 454 bp, Homo sapiens
atagcctggatagccaatgcaatcctaagcaaagagaacaaagcttgaggcatcacactatctgactttagactatactagaagggtacagtaatcaaaacagcatggtactggtagacgcacagaccaatggaacagttaagagaactcagaaataaagccacacaactacgaccatctgatctttgagaaagttgacaaaaacaagcaatggggaaaggattcattattcaacaagtggtgccaggttaactggatagccatgtaaagaagattgaaactggaccccttcctttcaccacatacaaaaattaactcaagatgcattaaagacttaaatgtaaaacctaaaactataaaattataaccctagaagaaagcctaggaaataccattatgtgatattggccctgatgaagatttcatgacaaaaactccagtagcaattgtgaaa

SEQ ID NO: 66231 - DNA, 1026 bp, Homo sapiens
tggatgattcttagcctatggagagtaaagcacaggtttttaagtttcttagatacactgtattgatgaggatacagactaagctgctgaaacaggagatcccagattatagtgacttcagctttttcagtcctcctggtggctggttcagggcttgtttggtggcttgtggggtcatcacattgtatactctcctgtcctgtgtgccagcacctggtcacatggccacccctgactgcaaggaagatgggaaaatgtcatcgttagctgggtaaccaggggcccagctaaaactcagggttctttttctaatagttgaaagggagagtgagtatcacagagccccagcagtttctctcctaagcatcttttattttccaatgaggacactgccaggccagttgtgtcttccttggctagagctttgatctgcaaacttggagctgattctgacctcagaccctggggtgacgagaggagctctatgattctagttagaccagcctaatggatgaatcctgactccctcacttgctgtttgtgtggccttcagttcggctgttgagcctctctgacattccgattcactggtaatgataactgtctcacaaagtcattgtaacaagtattttgagaacatccaggataatgccagtcatatgatgagttttcagtaaaagttcctttgttccttcctctataggatgaatcatagaaatcatctacttacctaacgcttccagtgaaacaagttaatttgctcagagcctgatttaatttgcattattgcatcaggatgacacctctttacagtaaagttatttatacttctccaaatgcaaaatttaaaattattttggctggacgtggtggctctcgcctgtaatcccagcactttgggaggccgaggaaggtggatcacttgaggtcaggagttcgagaccagcctggcaacatggtgaaaccctgtctctactaaaaatgcaaaaattagctgggcgtggtggcgcacacctgtaatcccag

SEQ ID NO: 66232 - DNA, 485 bp, Homo sapiens
cagcagggcagggctgtagccaggtgagcagagggcagaatcctcccctggaatacattagaccctgtggtgacattagttcatgctcagtgctctgttcacaatctctggtcctcacaacggccctgttagcgggttaggtgtgggcatgcagtgaggtgggtcctggaacttgtacccaggcttgtctgacaccagagcccatgctctccaccacagccgtgtctccaacctctccctagtgcttggtgctactgcaaggacttctttttccttctccccttaactgtcatgataaagtgacagcatctcagacaaatttaaaaattccctgaaggaatcagctggttggcgctgaactttgcagggtgccgtgaacaccctgggctggagtctgaatgcattgctttcctcatgcaacagtattgactgagccactgtaaacacacaagagtgtgcagtggcttcggggtccgagccgatcg

SEQ ID NO: 66233 - DNA, 689 bp, Homo sapiens
cagcagggcagggctgtagccaggtgagcagagggcagaatcctcccctggaatacattagaccttgtgtcttccttggctagagctttgatctgcaaacttggagctgattctgacctcagaccctggggtgacgagaggagctctatgattctagttagaccagcctaatggatgaatcctgactccctcacttgctgtttgtgtggccttcagttcggctgttgagcctctctgacattccgattcactggtaatgataactgtctcacaaagtcattgtaacaagtattttgagaacatccaggataatgccagtcatatgatgagttttcagtaaaagttcctttgttccttcctctataggatgaatcatagaaatcatctacttacctaacgcttccagtgaaacaagttaatttgctcagagcctgatttaatttgcattattgcatcaggatgacacctctttacagtaaagttatttatacttctccaaatgcaaaatttaaaattattttggctggacgtggtggctctcgcctgtaatcccagcactttgggaggccgaggaaggtggatcacttgaggtcaggagttcgagaccagcctggcaacatggtgaaaccctgtctctactaaaaatgcaaaaattagctgggcgtggtggcgcacacctgtaatcccag

SEQ ID NO: 66234 - DNA, 967 bp, Homo sapiens
cagcagggcagggctgtagccaggtgagcagagggcagaatcctcccctggaatacattagaccctgtggtgacattagttcatgctcagtgctctgttcacaatctctggtcctcacaacggccctgttagcgggttaggtgtgggcatgcagtgaggtgggtcctggaacttgtacccaggcttgtctgacaccagagcccatgctctccaccacagccgtgtctccaacctctccctagtgcttggtgctactgcaaggacttctttttccttctccccttaactgtcatgataaagtgacagcatctcagacaaatttaaaaattccctgaaggaatcagctggttggcgctgaactttgcagggtgccgtgaacaccctgggctggagtctgaatgcattgctttcctcatgcaacagtattgactgagccactgtaaacacacaagagttttgctgggtgctgagtgtattgtgagttttcatcgtctgtgctaatgctcatcttactgagcataataacctggagcatgacctatattgaattcacttggtggttgctgcaggatgcttaaaggaatgaaacttgagggtaggttaagggaagcaatggtgatgagctgagctttcaccaggtggcacctggctctggatgctgatgtgtttggatcagtggtagaaaacaagcaaatagaatggcgagttagacagtttccactgcgcacagcacttgggtgttttccatgctataaatctttattttttccactttggtttgagtgggatcacttccattggagctaatccagaaattgctaattcagtgggaattgtgagtctataagttaggaataaattgagcttaacatgcaatatattggaaatgatcctagatcctggatccttcctcttcccaaacagtgagctgtgagggagtcactcctcccaccaggttagaaccatc

SEQ ID NO: 66235 - DNA, 1063 bp, Homo sapiens
gcaatcccaaagccttttcaaccgcaggattgtcaggtttaggtgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaaaaaaaaaaaaaa

SEQ ID NO: 66236 - DNA, 1164 bp, Homo sapiens
gcaatcccaaagccttttcaaccgcaggattgtcaggtttaggtgagtctcatgtggctgctgcacctccagatatatgctctcgaacagtgtggcctgatgaaactatgggaccctttggacctcaagatcagaggttccagcttcctgggaacataggttttgattgtcacctcaatgggactgcttcacagaagaaaagcctggttcataaaactttgcctgatgttctagcagaacctttatcaagtgaaagacatgagtttgtgatggcacaatatgtgaatgaatttcagggtaatgatgcacctgttgaacaagaaattaacagtgcagaaacttactttgaaagtgccagagtagagtgtgcaatacaaacatgtccagaattgctgcgaaaagattttgaatcactgtttccagaagtagctaatggcaaactaatgattctgactgtaacacaaaaaactaagaatgatatgactgtttggagtgaagaagtagaaattgaaagagaagtgctcttagaaaagttcatcaatggtgctaaggaaatttgctatgctcttcgagctgagggttattgggctgactttattgacccatcatctggtttggcattttttggaccatatacaaacaacactctttttgaaactgatgaacgctaccgacatttaggattctctgttgatgaccttggatgctgtaaagtgattcgtcatagtctctggggtacccatgtagttgtagggagtatcttcactaatgcaacaccagacagccatattatgaagaaattaagtggaaattagcagaaatatccattcatttgctgtactatttgtatgtaatatttgggttgatctataaacactgtcagactaaagtttttaaaatatacttatttctaagtatttatttcagcatttatgaatttgcaacattggcaagtgatttgggattttaaaattgcaaatgttcatttattcatatcattgaatacacgttgaacacatccacattgtataggatgtggtaattagcttgtaaccagggtatgatctgctattgttatttctcctctttattggaaaaaggcctcagttttaattattttcttcccaaaataaatcacacatttggttacaaaaaaaaaaaaaa

SEQ ID NO: 66237 - DNA, 726 bp, Homo sapiens
tttggttcaatgccaactgaagtttgtcggcatcaccgttagccgttcagatgttccctaaggccgacatagcttggaatgttccggtttccctgatcacttggccattatttcgactgttccgcggctggagaacacccactacaagagttaggtggtgccacagatccatacccactgtcaggtcccttggacatggtttctggggtttagccctggctcccaataaggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctgcaaaaaaaccacaaaaaactcgagactagttctctctcc

SEQ ID NO: 66238 - DNA, 2633 bp, Homo sapiens
cgcgcaacttgcggccaaactttccccccggcctcccgcgctcggatggcggcccgctgagttggccgcagcccccgggcgagcggcggccaggccagaggacgccccctgcgcggctcgggccgggccatggcccgcgcgcccccgccggggccccagggcggcgggacgcgagtcctctgggcccccggcccgcgcctctagcgtgcccctcccggccccgggcccggccccgcgcacgcgtgggaaagttggcctggaaccggcccgaccagttccgcccgggcgcgaggaccggccgcaggaagttgctgcaaaacttttttggggggtgcagcccgtgccccccgcgcgccggggccgaatgcgcgccgcgtagggtcccccgggccgagaggggtgcccggagggaagagcgcggtgggggcgccccggccccgctgccctggggctatggccatggtgaccggcggctggggcggccccggcggcgacacgaacggcgtggacaaggcgggcggctacccgcgcgcggccgaggacgactcggcctcgccccccggtgccgccagcgacgccgagccgggcgacgaggagcggccggggctgcaggtggactgcgtggtgtgcggggacaagtcgagcggcaagcattacggtgtcttcacctgcgagggctgcaagagctttttcaagcgaagcatccgccgcaacctcagctacacctgccggtccaaccgtgactgccagatcgaccagcaccaccggaaccagtgccagtactgccgtctcaagaagtgcttccgggtgggcatgaggaaggaggcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcccctgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccgacgcctgtggcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctgaaaaaaaaaaaaaaaaaaaaaaaaaaaaaagggggggcggcaaaaatttcccccgagggggccccgaaaggatgaacccgcatccccagctttcgttgctaccaagatggggtcccctattacggcgacttcgtgttattctagcagtccatacgacgacgggggacggtcgttttcaaacacaacgctgcgtactgtgggaaaacggtggtatggctagtgggaaaaatttggggtggaagagagaacccttaaaatgtcctgtggaggagtggggcacaaatattgtgcggcaacaacataacctctagagagaaagtttataagcgctcttaggggatacatattatacagaattttgaaggcgtggtcaacaggggggtatacacatacctgagaaataatgactgagcagtgattggagaacagtgtgaggagcgaaggagaagaagtgaatttgcatcggaacacatctttttaaccagggatcatgttgaaaa

SEQ ID NO: 66239 - DNA, 1674 bp, Homo sapiens
cggccgcgcggatcgatacggcgcgcccttggggtcaaatatcacttccaaagtcgctgtggctacggaggcggcagacggagggaggctggggtggcacggggcggccttcttcgcatgaggggcccagcggtgggggtgggggtgggagctgggcttgcccatctcagggaacccctctgggctcactctgggccttgggtcaccggaaatcgccactggaaggccggcagggccaccggaattgactgaaacgtccctctcccccaggggtccaaccgtgactgccagatcgaccagcaccaccggaaccagtgccagtactgccgtctcaagaagtgcttccgggtgggcatgaggaaggaggcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcccctgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccgacgcctgtggcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctg

SEQ ID NO: 66240 - DNA, 2056 bp, Homo sapiens
cgcgcaacttgcggccaaactttccccccggcctcccgcgctcggatggcggcccgctgagttggccgcagcccccgggcgagcggcggccaggccagaggacgccccctgcgcggctcgggccgggccatggcccgcgcgcccccgccggggccccagggcggcgggacgcgagtcctctgggcccccggcccgcgcctctagcgtgcccctcccggccccgggcccggccccgcgcacgcgtgggaaagttggcctggaaccggcccgaccagttccgcccgggcgcgaggaccggccgcaggaagttgctgcaaaacttttttggggggtgcagcccgtgccccccgcgcgccggggccgaatgcgcgccgcgtagggtcccccgggccgagaggggtgcccggagggaagagcgcggtgggggcgccccggccccgctgccctggggctatggccatggtgaccggcggctggggcggccccggcggcgacacgaacggcgtggacaaggcgggcggctacccgcgcgcggccgaggacgactcggcctcgccccccggtgccgccagcgacgccgagccgggcgacgaggagcggccggggctgcaggtggactgcgtggtgtgcggggacaagtcgagcggcaagcattacggtgtcttcacctgcgagggctgcaagagctttttcaagcgaagcatccgccgcaacctcagctacacctgccggtccaaccgtgactgccagatcgaccagcaccaccggaaccagtgccagtactgccgtctcaagaagtgcttccgggtgggcatgaggaaggaggcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgaggctgcccctgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccgacgcctgtggcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctg

SEQ ID NO: 66241 - DNA, 487 bp, Homo sapiens
gcaggctagggaaatttctttattattggccttgagtcatcatgtagtgtctgacataggttacgtgtccagaggatctgcctggcacacgctagctacccctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctg

SEQ ID NO: 66242 - DNA, 287 bp, Homo sapiens
gatgcttctgccttggcctcccaaagtgctgggactgtggccgtgagccatcatgcccggccccctgttcttacccacagtggcgagtggtgtcccctagtcacccctgtgggctctgtgttctctagctgcctcccacctgtctgacttgcctttgtccccctagacgcctgtggcctctcagacccggcccacgttgagagcctgcaggagaaggcgcaggtggccctcaccgagtatgtgcgggcgcagtacccgtcccagccccagcgcttcgggcgcctgct

SEQ ID NO: 66243 - DNA, 412 bp, Homo sapiens
cagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctg

SEQ ID NO: 66244 - DNA, 2133 bp, Homo sapiens
cgcgcaacttgcggccaaactttccccccggcctcccgcgctcggatggcggcccgctgagttggccgcagcccccgggcgagcggcggccaggccagaggacgccccctgcgcggctcgggccgggccatggcccgcgcgcccccgccggggccccagggcggcgggacgcgagtcctctgggcccccggcccgcgcctctagcgtgcccctcccggccccgggcccggccccgcgcacgcgtgggaaagttggcctggaaccggcccgaccagttccgcccgggcgcgaggaccggccgcaggaagttgctgcaaaacttttttggggggtgcagcccgtgccccccgcgcgccggggccgaatgcgcgccgcgtagggtcccccgggccgagaggggtgcccggagggaagagcgcggtgggggcgccccggccccgctgccctggggctatggccatggtgaccggcggctggggcggccccggcggcgacacgaacggcgtggacaaggcgggcggctacccgcgcgcggccgaggacgactcggcctcgccccccggtgccgccagcgacgccgagccgggcgacgaggagcggccggggctgcaggtggactgcgtggtgtgcggggacaagtcgagcggcaagcattacggtgtcttcacctgcgagggctgcaagagctttttcaagcgaagcatccgccgcaacctcagctacacctgccggtccaaccgtgactgccagatcgaccagcaccaccggaaccagtgccagtactgccgtctcaagaagtgcttccgggtgggcatgaggaaggaggcggtgcagcgcggccgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggtgctgggcatcgacaacgtgtgcgagctggcggcgcggctgctcttcagcaccgtggagtgggcgcgccacgcgcccttcttccccgagctgccggtggccgaccaggtggcgctgctgcgcctgagctggagcgagctcttcgtgctgaacgcggcgcaggcggcgctgcccctgcacacggcgccgctactggccgccgccggcctccacgccgcgcctatggccgccgagcgcgccgtggctttcatggaccaggtgcgcgccttccaggagcaggtggacaagctgggccgcctgcaggtcgactcggccgagtatggctgcctcaaggccatcgcgctcttcacgcccgacgcctgtggcctctcagacccggcccacgttgagagcctgcaggagaaggcgcaggtggccctcaccgagtatgtgcgggcgcagtacccgtcccagccccagcgcttcgggcgcctgctgctgcggctccccgccctgcgcgcggtccctgcctccctcatctcccagctgttcttcatgcgcctggtggggaagacgcccattgagacactgatcagagacatgctgctgtcggggagtaccttcaactggccctacggctcgggccagtgaccatgacggggccacgtgtgctgtggccaggcctgcagacagacctcaagggacagggaatgctgaggcctcgaggggcctcccggggcccaggactctggcttctctcctcagacttctattttttaaagactgtgaaatgtttgtcttttctgttttttaaatgatcatgaaaccaaaaagagactgatcatccaggcctcagcctcatcctccccaggacccctgtccaggatggagggtccaatcctaggacagccttgttcctcagcacccctagcatgaacttgtgggatggtggggttggcttccctggcatgatggacaaaggcctggcgtcggccagaggggctgctccagtgggcaggggtagctagcgtgtgccaggcagatcctctggacacgtaacctatgtcagacactacatgatgactcaaggccaataataaagacatttcctacctg

SEQ ID NO: 66245 - DNA, 627 bp, Homo sapiens
acggccgctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcagacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgtttatcaaaaaaaagagaaaatgacaag

SEQ ID NO: 66246 - DNA, 6049 bp, Homo sapiens
acggccgctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcagacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgtttatcaaaaaaaagagaaaatgacaaggtgaagtatgaagtaacagaagatgtgtacacatccagaaagaaacaacaccagaccatgatgcattatttttgtgcattaaatactcttcagtacaagaagaaaatagcattgttagaacctctacttgggtacatgcaagctcagataagtttctttaagatgggttctgaaaatcttaatgaacaactggaagaatttttagctaatattggaacaagcgttcagaatgttcgcagggaaatggacagtgatatagagaccatgcaacagacaatagaggatttggaagtagccagtgatcccttatatgtgcctgacccagaccccaccaaatttcctgttaatcgaaatttaacccgaaaggctggataccttaatgctaggaataaaacaggcttggtgtcatctacctgggacagacagttttacttcacgcagggtggaaatttaatgagtcaggcccgtggggatgtagcaggaggcctggccatggacatagacaactgttcagtgatggctgtggactgtgaagacagacgatattgttttcagatcacctctttcgatggaaaaaaatcttcaattttgcaagcagagagtaaaaaagatcatgaagagtggatctgtacaataaacaacatatctaaacaaatatacttaagtgaaaatccagaggaaactgctgcacgagtaaatcaatcagctctggaagctgtcactccttccccatctttccagcagaggcacgagagcctgcggccagcagcaggacaatctcggccaccgacagctcgaaccagcagttcaggatccttaggatctgagtctacaaatttggctgccctctctctagattctcttgttgccccagacaccccaatacagtttgacataatttctcctgtgtgtgaagatcagcctggccaggcaaaagcctttggccagggaggcaggcgtacaaatccatttggagaatctggaggaagtacaaaatctgaaactgaagattctattcttcatcagttatttattgtccgattccttggttcaatggaggtgaaatcagatgaccatccagatgttgtttatgaaactatgcgccaaatcttagctgcccgggccatccataacatctttcgtatgacagaatcgcatttattagtcacttgtgactgtttaaagttaattgatccacagacacaagttacaaggctcacgtttccattaccttgtgtagttttgtatgctacacaccaggaaaataagcgcctttttggatttgttcttcggacatcaagcgggagaagtgaaagtaatctgtcatcagtctgctatatatttgagtcaaacaatgagggggaaaagatatgtgattctgttggactggcaaaacagatagctttgcatgctgaactggatcgtagggcatcagaaaaacaaaaagaaatagagagagtaaaagagaagcaacagaaagaactcaataaacaaaaacagattgaaaaggacttggaagaacaaagtcggttgatagctgcttccagtagaccaaaccaagccagtagtgaggggcagtttgttgtccttagcagtagccagtcagaagagagtgatttgggagaaggaggaaagaagagagaatcagaagcataagcttatacttttggtagatattcccccttggaatttgacagtttctatggtgaaatggcagaaggtaacaactatgttgaaatatcaaggaggagattaagctttatatttgcttatttgttgtagctacattttaaaaaaaagattgaacttgatgacttaggtttgcattgatcttttttcccccttaaacataatgtactatgtattaacatctaaaggaaacctgctcatctccctgaagcagactgctgaggaattacatttgctcaagaattttttccgtcaaattgtgaacttttaattcttgcattgtaattggctgtgtccataagaaatcatttattcttcaggcttagacattcatggatatgcttttctttcattaggaacattttgctggtgatgaggaagcatttagctgaataagtttaaagccctttatacagagaattctacaagtttgcaaatattttaacaatattaaatgtgcaatagaacttttataaaataattagaacagagattttacagttaaggtttcaaattgtggcaggtggtactgttgatctcagggtactttctgggattgctcacatttctctaatgtactgcacttgatgccagtaggaaagaagcttaagtgtcttcagttcaagattgatagagcccttggcattttattatcacattcttagttctcaggttgggacttcaattactgctgcagagcagtagtggttaaaaataagatattggaatttattaaaagatttttgttcaatacattttagattaggattgacaagtaaagatactgctatggaatgatacattgtattttctgcattgtgtgaaatagtttttattgaaagtcaagtgacatttcaaaagaagttctataacaattatgtttcatgcttaaagtaaaaattcccagagtttagtttagaaaatgtaatcttttaaatttcagactgatatattcccagtattttcataatgccatgttttgataaagtactgaatcaccactttatatccacaaaggcaaataactaatgtatgataatagaataatttgcactaattattgtaaatatgtctactcttcaaatgagtaaaaggtccaattttgtgaaagattgaaaatgaattgaatgcctagtagagtataggagaagttgaccaaggaaggatttaacctggtgccaaggttaaaataacatttctctactgcctattgtttatgttaaaccttaattttttttctgtaatcacttttaacactgctaatagaaattatgttttcatgtgtttcacatgaaaaagtatatatatacaaagttaatatagtgggtaaaatactttacatagtcacacatttacaaatttttcaagaggttagccactaagactttaataattttacaagggaaaaagcctttttttttctttgatatacagttttttcttcttagttctgcattagaaatggcatctgttttaggtctcaaaatataactcagctgtttcacactgtatatgtacattgttttctgtaggaataggataatgatatataggatcatgatattccttctatccatgtgccaaatgggtgtaatgtttatttactgatgctttatgttaccaaaacatacagtaaaaaagtagaaatttatgaaatacttttgataaaaagtttattttgtgcttaccaaaaggaatgctttcacaatagtgtatcagttcttttgttttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagagttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggattaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaataaaatgaaaaaaaaagtgtttttttgagacagagtcttgctctgttgcccaggctggagtgcagtggtgtgatcttgggtcactgcaaactccgcctcccaggttcacgccattctcctgcctcagcctcccgagtagctgggaccacaggggcccaccaccgcgcccggctaattttttgtatttttagtagagacggggtttcaccgtgttagccaggatgttctcgatctcctgacctcatgatccgcccgcctcggcctcccaaagtgctgggattacaggcgtgagccaccgtgcccggccctaaaatgaaattattaatgttggttctgaaacagcctcttagcattcagattgtattttaaatacttaaacacaccaattgtagaaagcaaccctttatttttagcaagtttggtttactcttctcccatgagattttgtctttctacattaactagtaagacataaagatttgaaactggaactatattatactttttaaccaatctctgtggcttcactcatgaaatttacttcagttaatatgagactgggggttaagttgtaactaatatgcaaaattgctttgtatatttggtgattttgtaatgtaagtgaattgattcttatttcactgatactattaatcatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgta

SEQ ID NO: 66247 - DNA, 681 bp, Homo sapiens
gagctgtgaaatggctaggcatttccagaaaaatgttgaaaaatcgcggatggtctttatgtagagtgtttaatgcaatcggattacataaactgggattacaggcgtgagccaccgtgcccggccctaaaatgaaattattaatgttggttctgaaacagcctcttagcattcagattgtattttaaatacttaaacacaccaattgtagaaagcaaccctttatttttagcaagtttggtttactcttctcccatgagattttgtctttctacattaactagtaagacataaagatttgaaactggaactatattatactttttaaccaatctctgtggcttcactcatgaaatttacttcagttaatatgagactgggggttaagttgtaactaatatgcaaaattgctttgtatatttggtgattttgtaatgtaagtgaattgattcttatttcactgatactattaatcatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgta

SEQ ID NO: 66248 - DNA, 681 bp, Homo sapiens
acggccgctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcagaatagagtccaagaagcagagcagcaaagaatatgaagacttttaaagctcatgacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgtttatcaaaaaaaagagaaaatgacaag

SEQ ID NO: 66249 - DNA, 814 bp, Homo sapiens
  misc_feature (814)..(814): n is a, c, g, or t
cggacgcgtgggattcaaaatcatgcaatgtttcactttagaattgtacactgcatgattaatagtatcagtgaaataagaatcaattcacttacattacaatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgtaaaaaaaaaaaaaaaaaaaaaaaaaaaaaaaaaaaaaaaaaagggggggcgcgccgccaaaaaattccccccggggggccccattccgccccccgtttttttgtaaaaggggcccccaaaagggggagccgcgataataaaagcacagaggcacagcgggcccgccgtcgttttaaacaacagcgtgccgggaagcggggaaacaccgcggtccgtagcgtctgggggatatccttgtgtcgggagagggaacccctatactttcggtgggggcgtggccgcacaatcatggcggcagaaccatcatccctctcccagagagattttaccggcgcccgcagggcgaaattaataacacttctacacggcggcttttatgtggtgttcaaacaccaagccgcgcatatattgcttcggccggctctgaaaaaacttcggctcaacggaactattgtattttcgagcaaacatctttttccgccgggagcattgtggtgatataaccaan

SEQ ID NO: 66250 - DNA, 529 bp, Homo sapiens
ggtgtctagaggatcccacgcgtcaagcaacagaaagaactcaataaacaaaaacagattgaaaaggtatacagtcctaatgtctggatctttatgtgttgtttgtgaagacttaattcagcactatgactttcagatttgaatttccaaatgaagggctgtttctgcttgttcagccacttcataaacagatgattcataccatagcagaaaagggtcacatctgttttttgatatgatgtttacattatagttacgttgacatgtaatatgactgtttcaaaaatataccagaactttaatatttcagaggaggttgtctctgtcaaagcagttgagaggctgtgtagacttaactgccattgctgaaagccattttgccttctatgggggggaaataaataaatatatatgttatatgaaatatataatgaaatgtatatttttaatattgccaggagtgtcaaatcattgtccatccaacagaataattttaaaagacaaatttcagagcaaaacttgaagaatg

SEQ ID NO: 66251 - DNA, 5995 bp, Homo sapiens
acggccgctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcagacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgtttatcaaaaaaaagagaaaatgacaaggtgaagtatgaagtaacagaagatgtgtacacatccagaaagaaacaacaccagaccatgatgcattatttttgtgcattaaatactcttcagtacaagaagaaaatagcattgttagaacctctacttgggtacatgcaagctcagataagtttctttaagatgggttctgaaaatcttaatgaacaactggaagaatttttagctaatattggaacaagcgttcagaatgttcgcagggaaatggacagtgatatagagaccatgcaacagacaatagaggatttggaagtagccagtgatcccttatatgtgcctgacccagaccccaccaaatttcctgttaatcgaaatttaacccgaaaggctggataccttaatgctaggaataaaacaggcttggtgtcatctacctgggacagacagttttacttcacgcagggtggaaatttaatgagtcaggcccgtggggatgtagcaggaggcctggccatggacatagacaactgttcagtgatggctgtggactgtgaagacagacgatattgttttcagatcacctctttcgatggaaaaaaatcttcaattttgcaagcagagagtaaaaaagatcatgaagagtggatctgtacaataaacaacatatctaaacaaatatacttaagtgaaaatccagaggaaactgctgcacgagtaaatcaatcagctctggaagctgtcactccttccccatctttccagcagaggcacgagagcctgcggccagcagcaggacaatctcggccaccgacagctcgaaccagcagttcaggatccttaggatctgagtctacaaatttggctgccctctctctagattctcttgttgccccagacaccccaatacagtttgacataatttctcctgtgtgtgaagatcagcctggccaggcaaaagcctttggccagggaggcaggcgtacaaatccatttggagaatctggaggaagtacaaaatctgaaactgaagattctattcttcatcagttatttattgtccgattccttggttcaatggaggtgaaatcagatgaccatccagatgttgtttatgaaactatgcgccaaatcttagctgcccgggccatccataacatctttcgtatgacagaatcgcatttattagtcacttgtgactgtttaaagttaattgatccacagacacaagttacaaggctcacgtttccattaccttgtgtagttttgtatgctacacaccaggaaaataagcgcctttttggatttgttcttcggacatcaagcgggagaagtgaaagtaatctgtcatcagtctgctatatatttgagtcaaacaatgagggggaaaagatatgtgattctgttggactggcaaaacagatagctttgcatgctgaactggatcgtagggcatcagaaaaacaaaaagaaatagagagagtaaaagagaagcaacagaaagaactcaataaacaaaaacagattgaaaaggacttggaagaacaaagtcggttgatagctgcttccagtagaccaaaccaagccagtagtgaggggcagtttgttgtccttagcagtagccagtcagaagagagtgatttgggagaaggaggaaagaagagagaatcagaagcataagcttatacttttggtagatattcccccttggaatttgacagtttctatggtgaaatggcagaaggtaacaactatgttgaaatatcaaggaggagattaagctttatatttgcttatttgttgtagctacattttaaaaataatgtactatgtattaacatctaaaggaaacctgctcatctccctgaagcagactgctgaggaattacatttgctcaagaattttttccgtcaaattgtgaacttttaattcttgcattgtaattggctgtgtccataagaaatcatttattcttcaggcttagacattcatggatatgcttttctttcattaggaacattttgctggtgatgaggaagcatttagctgaataagtttaaagccctttatacagagaattctacaagtttgcaaatattttaacaatattaaatgtgcaatagaacttttataaaataattagaacagagattttacagttaaggtttcaaattgtggcaggtggtactgttgatctcagggtactttctgggattgctcacatttctctaatgtactgcacttgatgccagtaggaaagaagcttaagtgtcttcagttcaagattgatagagcccttggcattttattatcacattcttagttctcaggttgggacttcaattactgctgcagagcagtagtggttaaaaataagatattggaatttattaaaagatttttgttcaatacattttagattaggattgacaagtaaagatactgctatggaatgatacattgtattttctgcattgtgtgaaatagtttttattgaaagtcaagtgacatttcaaaagaagttctataacaattatgtttcatgcttaaagtaaaaattcccagagtttagtttagaaaatgtaatcttttaaatttcagactgatatattcccagtattttcataatgccatgttttgataaagtactgaatcaccactttatatccacaaaggcaaataactaatgtatgataatagaataatttgcactaattattgtaaatatgtctactcttcaaatgagtaaaaggtccaattttgtgaaagattgaaaatgaattgaatgcctagtagagtataggagaagttgaccaaggaaggatttaacctggtgccaaggttaaaataacatttctctactgcctattgtttatgttaaaccttaattttttttctgtaatcacttttaacactgctaatagaaattatgttttcatgtgtttcacatgaaaaagtatatatatacaaagttaatatagtgggtaaaatactttacatagtcacacatttacaaatttttcaagaggttagccactaagactttaataattttacaagggaaaaagcctttttttttctttgatatacagttttttcttcttagttctgcattagaaatggcatctgttttaggtctcaaaatataactcagctgtttcacactgtatatgtacattgttttctgtaggaataggataatgatatataggatcatgatattccttctatccatgtgccaaatgggtgtaatgtttatttactgatgctttatgttaccaaaacatacagtaaaaaagtagaaatttatgaaatacttttgataaaaagtttattttgtgcttaccaaaaggaatgctttcacaatagtgtatcagttcttttgttttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagagttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggattaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaataaaatgaaaaaaaaagtgtttttttgagacagagtcttgctctgttgcccaggctggagtgcagtggtgtgatcttgggtcactgcaaactccgcctcccaggttcacgccattctcctgcctcagcctcccgagtagctgggaccacaggggcccaccaccgcgcccggctaattttttgtatttttagtagagacggggtttcaccgtgttagccaggatgttctcgatctcctgacctcatgatccgcccgcctcggcctcccaaagtgctgggattacaggcgtgagccaccgtgcccggccctaaaatgaaattattaatgttggttctgaaacagcctcttagcattcagattgtattttaaatacttaaacacaccaattgtagaaagcaaccctttatttttagcaagtttggtttactcttctcccatgagattttgtctttctacattaactagtaagacataaagatttgaaactggaactatattatactttttaaccaatctctgtggcttcactcatgaaatttacttcagttaatatgagactgggggttaagttgtaactaatatgcaaaattgctttgtatatttggtgattttgtaatgtaagtgaattgattcttatttcactgatactattaatcatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgta

SEQ ID NO: 66252 - DNA, 6072 bp, Homo sapiens
acggccgctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcagacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgtttatcaaaaaaaagagaaaatgacaaggtgaagtatgaagtaacagaagatgtgtacacatccagaaagaaacaacaccagaccatgatgcattatttttgtgcattaaatactcttcagtacaagaagaaaatagcattgttagaacctctacttgggtacatgcaagctcagataagtttctttaagatgggttctgaaaatcttaatgaacaactggaagaatttttagctaatattggaacaagcgttcagaatgttcgcagggaaatggacagtgatatagagaccatgcaacagacaatagaggatttggaagtagccagtgatcccttatatgtgcctgacccagaccccaccaaatttcctgttaatcgaaatttaacccgaaaggctggataccttaatgctaggaataaaacaggcttggtgtcatctacctgggacagacagttttacttcacgcagggtggaaatttaatgagtcaggcccgtggggatgtagcaggaggcctggccatggacatagacaactgttcagtgatggctgtggactgtgaagacagacgatattgttttcagatcacctctttcgatggaaaaaaatcttcaattttgcaagcagagagtaaaaaagatcatgaagagtggatctgtacaataaacaacatatctaaacaaatatacttaagtgaaaatccagaggaaactgctgcacgagtaaatcaatcagctctggaagctgtcactccttccccatctttccagcagaggcacgagagcctgcggccagcagcaggacaatctcggccaccgacagctcgaaccagcagttcaggatccttaggatctgagtctacaaatttggctgccctctctctagattctcttgttgccccagacaccccaatacagtttgacataatttctcctgtgtgtgaagatcagcctggccaggcaaaagcctttggccagggaggcaggcgtacaaatccatttggagaatctggaggaagtacaaaatctgaaactgaagattctattcttcatcagttatttattgtccgattccttggttcaatggaggtgaaatcagatgaccatccagatgttgtttatgaaactatgcgccaaatcttagctgcccgggccatccataacatctttcgtatgacagaatcgcatttattagtcacttgtgactgtttaaagttaattgatccacagacacaagttacaaggctcacgtttccattaccttgtgtagttttgtatgctacacaccaggaaaataagcgcctttttggatttgttcttcggacatcaagcgggagaagtgaaagtaatctgtcatcagtctgctatatatttgagtcaaacaatgagggggaaaagatatgtgattctgttggactggcaaaacagatagctttgcatgctgaactggatcgtagggcatcagaaaaacaaaaagaaatagagagagtaaaagagaagcaacagaaagaactcaataaacaaaaacagattgaaaaggacttggaagaacaaagtcggttgatagctgcttccagtagaccaaaccaagccagtagtgaggggcagtttgttgtccttagcagtagccagtcagaagagagtgatttgggagaaggaggaaagaagagagaatcagaagcataagcttatacttttggtagatattcccccttggaatttgacagtttctatggtgaaatggcagaaggtaacaactatgttgaaatatcaaggaggagattaagctttatatttgcttatttgttgtagctacattttaaaaaaaagattgaacttgatgacttaggtttgcattgatcttttttcccccttaaacataatgtactatgtattaacatctaaaggaaacctgctcatctccctgaagcagactgctgaggaattacatttgctcaagaattttttccgtcaaattgtgaacttttaattcttgcattgtaattggctgtgtccataagaaatcatttattcttcaggcttagacattcatggatatgcttttctttcattaggaacattttgctggtgatgaggaagcatttagctgaataagtttaaagccctttatacagagaattctacaagtttgcaaatattttaacaatattaaatgtgcaatagaacttttataaaataattagaacagagattttacagttaaggtttcaaattgtggcaggtggtactgttgatctcagggtactttctgggattgctcacatttctctaatgtactgcacttgatgccagtaggaaagaagcttaagtgtcttcagttcaagattgatagagcccttggcattttattatcacattcttagttctcaggttgggacttcaattactgctgcagagcagtagtggttaaaaataagatattggaatttattaaaagatttttgttcaatacattttagattaggattgacaagtaaagatactgctatggaatgatacattgtattttctgcattgtgtgaaatagtttttattgaaagtcaagtgacatttcaaaagaagttctataacaattatgtttcatgcttaaagtaaaaattcccagagtttagtttagaaaatgtaatcttttaaatttcagactgatatattcccagtattttcataatgccatgttttgataaagtactgaatcaccactttatatccacaaaggcaaataactaatgtatgataatagaataatttgcactaattattgtaaatatgtctactcttcaaatgagtaaaaggtccaattttgtgaaagattgaaaatgaattgaatgcctagtagagtataggagaagttgaccaaggaaggatttaacctggtgccaaggttaaaataacatttctctactgcctattgtttatgttaaaccttaattttttttctgtaatcacttttaacactgctaatagaaattatgttttcatgtgtttcacatgaaaaagtatatatatacaaagttaatatagtgggtaaaatactttacatagtcacacatttacaaatttttcaagaggttagccactaagactttaataattttacaagggaaaaagcctttttttttctttgatatacagttttttcttcttagttctgcattagaaatggcatctgttttaggtctcaaaatataactcagctgtttcacactgtatatgtacattgttttctgtaggaataggataatgatatataggatcatgatattccttctatccatgtgccaaatgggtgtaatgtttatttactgatgctttatgttaccaaaacatacagtaaaaaagtagaaatttatgaaatacttttgataaaaagtttattttgtgcttaccaaaaggaatgctttcacaatagtgtatcagttcttttgttttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagagttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggattaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaataaaatgaaaaaaaaagtgtttttttgagacagagtcttgctctgttgcccaggctggagtgcagtggtgtgatcttgggtcactgcaaactccgcctcccaggttcacgccattctcctgcctcagcctcccgagtagctgggaccacaggggcccaccaccgcgcccggctaattttttgtatttttagtagagacggggtttcaccgtgttagccaggatgttctcgatctcctgacctcatgatccgcccgcctcggcctcccaaagtgctgggattacaggcgtgagccaccgtgcccggccctaaaatgaaattattaatgttggttctgaaacagcctcttagcattcagattgtattttaaatacttaaacacaccaattgtagaaagcaaccctttatttttagcaagtttggtttactcttctcccatgagattttgtctttctacattaactagtaagacataaagatttgaaactggaactatattatactttttaaccaatctctgtggcttcactcatgaaatttacttcagttaatatgagactgggggttaagttgtaactaatatgcaaaattgctttgtatatttggtgattttgtaatgtaagtgaattgattcttatttcactgatactattaatcatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgtacagtgttttttaatgaaaaattt

SEQ ID NO: 66253 - DNA, 4849 bp, Homo sapiens
tactactactaaattcgcggccgcgtcgacaaaaaagatcatgaagagtggatctgtacaataaacaacatatctaaacaaatatacttaagtgaaaatccagaggaaactgctgcacgagtaaatcaatcagctctggaagctgtcactccttccccatctttccagcagaggcacgagagcctgcggccagcagcaggacaatctcggccaccgacagctcgaaccagcagttcaggatccttaggatctgagtctacaaatttggctgccctctctctagattctcttgttgccccagacaccccaatacagtttgacataatttctcctgtgtgtgaagatcagcctggccaggcaaaagcctttggccagggaggcaggcgtacaaatccatttggagaatctggaggaagtacaaaatctgaaactgaagattctattcttcatcagttatttattgtccgattccttggttcaatggaggtgaaatcagatgaccatccagatgttgtttatgaaactatgcgccaaatcttagctgcccgggccatccataacatctttcgtatgacagaatcgcatttattagtcacttgtgactgtttaaagttaattgatccacagacacaagttacaaggctcacgtttccattaccttgtgtagttttgtatgctacacaccaggaaaataagcgcctttttggatttgttcttcggacatcaagcgggagaagtgaaagtaatctgtcatcagtctgctatatatttgagtcaaacaatgagggggaaaagatatgtgattctgttggactggcaaaacagatagctttgcatgctgaactggatcgtagggcatcagaaaaacaaaaagaaatagagagagtaaaagagaagcaacagaaagaactcaataaacaaaaacagattgaaaaggacttggaagaacaaagtcggttgatagctgcttccagtagaccaaaccaagccagtagtgaggggcagtttgttgtccttagcagtagccagtcagaagagagtgatttgggagaaggaggaaagaagagagaatcagaagcataagcttatacttttggtagatattcccccttggaatttgacagtttctatggtgaaatggcagaaggtaacaactatgttgaaatatcaaggaggagattaagctttatatttgcttatttgttgtagctacattttaaaaaaaagattgaacttgatgacttaggtttgcattgatcttttttcccccttaaacataatgtactatgtattaacatctaaaggaaacctgctcatctccctgaagcagactgctgaggaattacatttgctcaagaattttttccgtcaaattgtgaacttttaattcttgcattgtaattggctgtgtccataagaaatcatttattcttcaggcttagacattcatggatatgcttttctttcattaggaacattttgctggtgatgaggaagcatttagctgaataagtttaaagccctttatacagagaattctacaagtttgcaaatattttaacaatattaaatgtgcaatagaacttttataaaataattagaacagagattttacagttaaggtttcaaattgtggcaggtggtactgttgatctcagggtactttctgggattgctcacatttctctaatgtactgcacttgatgccagtaggaaagaagcttaagtgtcttcagttcaagattgatagagcccttggcattttattatcacattcttagttctcaggttgggacttcaattactgctgcagagcagtagtggttaaaaataagatattggaatttattaaaagatttttgttcaatacattttagattaggattgacaagtaaagatactgctatggaatgatacattgtattttctgcattgtgtgaaatagtttttattgaaagtcaagtgacatttcaaaagaagttctataacaattatgtttcatgcttaaagtaaaaattcccagagtttagtttagaaaatgtaatcttttaaatttcagactgatatattcccagtattttcataatgccatgttttgataaagtactgaatcaccactttatatccacaaaggcaaataactaatgtatgataatagaataatttgcactaattattgtaaatatgtctactcttcaaatgagtaaaaggtccaattttgtgaaagattgaaaatgaattgaatgcctagtagagtataggagaagttgaccaaggaaggatttaacctggtgccaaggttaaaataacatttctctactgcctattgtttatgttaaaccttaattttttttctgtaatcacttttaacactgctaatagaaattatgttttcatgtgtttcacatgaaaaagtatatatatacaaagttaatatagtgggtaaaatactttacatagtcacacatttacaaatttttcaagaggttagccactaagactttaataattttacaagggaaaaagcctttttttttctttgatatacagttttttcttcttagttctgcattagaaatggcatctgttttaggtctcaaaatataactcagctgtttcacactgtatatgtacattgttttctgtaggaataggataatgatatataggatcatgatattccttctatccatgtgccaaatgggtgtaatgtttatttactgatgctttatgttaccaaaacatacagtaaaaaagtagaaatttatgaaatacttttgataaaaagtttattttgtgcttaccaaaaggaatgctttcacaatagtgtatcagttcttttgttttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagagttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggattaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaataaaatgaaaaaaaaagtgtttttttgagacagagtcttgctctgttgcccaggctggagtgcagtggtgtgatcttgggtcactgcaaactccgcctcccaggttcacgccattctcctgcctcagcctcccgagtagctgggaccacaggggcccaccaccgcgcccggctaattttttgtatttttagtagagacggggtttcaccgtgttagccaggatgttctcgatctcctgacctcatgatccgcccgcctcggcctcccaaagtgctgggattacaggcgtgagccaccgtgcccggccctaaaatgaaattattaatgttggttctgaaacagcctcttagcattcagattgtattttaaatacttaaacacaccaattgtagaaagcaaccctttatttttagcaagtttggtttactcttctcccatgagattttgtctttctacattaactagtaagacataaagatttgaaactggaactatattatactttttaaccaatctctgtggcttcactcatgaaatttacttcagttaatatgagactgggggttaagttgtaactaatatgcaaaattgctttgtatatttggtgattttgtaatgtaagtgaattgattcttatttcactgatactattaatcatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgta

SEQ ID NO: 66254 - DNA, 4731 bp, Homo sapiens
tggtttattatgttgattttttgttgtgtatgtctaaacttccaattcatctgtgtcttctaaagtgcaccaacattgatcagttagtgtgtgagggcagaggccttcatcatagtaatttagtgatcaatagtgtttcttaataggatggggcattttagagctttttttttttaaatgttaactgtggttttaataattagatttcttctatgtggctcatggtaactgaccatgtgttcatattttcttctaaactttttaggcgtacaaatccatttggagaatctggaggaagtacaaaatctgaaactgaagattctattcttcatcagttatttattgtccgattccttggttcaatggaggtgaaatcagatgaccatccagatgttgtttatgaaactatgcgccaaatcttagctgcccgggccatccataacatctttcgtatgacagaatcgcatttattagtcacttgtgactgtttaaagttaattgatccacagacacaagttacaaggctcacgtttccattaccttgtgtagttttgtatgctacacaccaggaaaataagcgcctttttggatttgttcttcggacatcaagcgggagaagtgaaagtaatctgtcatcagtctgctatatatttgagtcaaacaatgagggggaaaagatatgtgattctgttggactggcaaaacagatagctttgcatgctgaactggatcgtagggcatcagaaaaacaaaaagaaatagagagagtaaaagagaagcaacagaaagaactcaataaacaaaaacagattgaaaaggacttggaagaacaaagtcggttgatagctgcttccagtagaccaaaccaagccagtagtgaggggcagtttgttgtccttagcagtagccagtcagaagagagtgatttgggagaaggaggaaagaagagagaatcagaagcataagcttatacttttggtagatattcccccttggaatttgacagtttctatggtgaaatggcagaaggtaacaactatgttgaaatatcaaggaggagattaagctttatatttgcttatttgttgtagctacattttaaaaaaaagattgaacttgatgacttaggtttgcattgatcttttttcccccttaaacataatgtactatgtattaacatctaaaggaaacctgctcatctccctgaagcagactgctgaggaattacatttgctcaagaattttttccgtcaaattgtgaacttttaattcttgcattgtaattggctgtgtccataagaaatcatttattcttcaggcttagacattcatggatatgcttttctttcattaggaacattttgctggtgatgaggaagcatttagctgaataagtttaaagccctttatacagagaattctacaagtttgcaaatattttaacaatattaaatgtgcaatagaacttttataaaataattagaacagagattttacagttaaggtttcaaattgtggcaggtggtactgttgatctcagggtactttctgggattgctcacatttctctaatgtactgcacttgatgccagtaggaaagaagcttaagtgtcttcagttcaagattgatagagcccttggcattttattatcacattcttagttctcaggttgggacttcaattactgctgcagagcagtagtggttaaaaataagatattggaatttattaaaagatttttgttcaatacattttagattaggattgacaagtaaagatactgctatggaatgatacattgtattttctgcattgtgtgaaatagtttttattgaaagtcaagtgacatttcaaaagaagttctataacaattatgtttcatgcttaaagtaaaaattcccagagtttagtttagaaaatgtaatcttttaaatttcagactgatatattcccagtattttcataatgccatgttttgataaagtactgaatcaccactttatatccacaaaggcaaataactaatgtatgataatagaataatttgcactaattattgtaaatatgtctactcttcaaatgagtaaaaggtccaattttgtgaaagattgaaaatgaattgaatgcctagtagagtataggagaagttgaccaaggaaggatttaacctggtgccaaggttaaaataacatttctctactgcctattgtttatgttaaaccttaattttttttctgtaatcacttttaacactgctaatagaaattatgttttcatgtgtttcacatgaaaaagtatatatatacaaagttaatatagtgggtaaaatactttacatagtcacacatttacaaatttttcaagaggttagccactaagactttaataattttacaagggaaaaagcctttttttttctttgatatacagttttttcttcttagttctgcattagaaatggcatctgttttaggtctcaaaatataactcagctgtttcacactgtatatgtacattgttttctgtaggaataggataatgatatataggatcatgatattccttctatccatgtgccaaatgggtgtaatgtttatttactgatgctttatgttaccaaaacatacagtaaaaaagtagaaatttatgaaatacttttgataaaaagtttattttgtgcttaccaaaaggaatgctttcacaatagtgtatcagttcttttgttttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagagttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggattaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaataaaatgaaaaaaaaagtgtttttttgagacagagtcttgctctgttgcccaggctggagtgcagtggtgtgatcttgggtcactgcaaactccgcctcccaggttcacgccattctcctgcctcagcctcccgagtagctgggaccacaggggcccaccaccgcgcccggctaattttttgtatttttagtagagacggggtttcaccgtgttagccaggatgttctcgatctcctgacctcatgatccgcccgcctcggcctcccaaagtgctgggattacaggcgtgagccaccgtgcccggccctaaaatgaaattattaatgttggttctgaaacagcctcttagcattcagattgtattttaaatacttaaacacaccaattgtagaaagcaaccctttatttttagcaagtttggtttactcttctcccatgagattttgtctttctacattaactagtaagacataaagatttgaaactggaactatattatactttttaaccaatctctgtggcttcactcatgaaatttacttcagttaatatgagactgggggttaagttgtaactaatatgcaaaattgctttgtatatttggtgattttgtaatgtaagtgaattgattcttatttcactgatactattaatcatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgta

SEQ ID NO: 66255 - DNA, 2259 bp, Homo sapiens
gaggatcccggtcatcttctacactcaatttctacactatgtacattgttttctgtaggaataggataatgatatataggatcatgatattccttctatccatgtgccaaatgggtgtaatgtttatttactgatgctttatgttaccaaaacatacagtaaaaaagtagaaatttatgaaatacttttgataaaaagtttattttgtgcttaccaaaaggaatgctttcacaatagtgtatcagttcttttgttttgttaaagttggaatttattctgttgccagcatttaagtagtcatggcaagtcctgtttttaagaccttttggagactggagctttctgttccattaagtcttttgtttatactacaaattgtcacctcacttagttcagatgaaatctgttactctacaaggaaggtgttcatcattaggaggcagctttactaagctggtgctttgcatggtagcaagtgctgccctttatcagcaccctgggtcatagtgtaggctagagttaaggcactggcagacttagggatgctggacagacctgtagttcgttttaagtcatgttcacaggaatttctacaataataaacccatcatctccataggtcagatcgaagtgcattccaatgctaaatagaagttatgagtgggtttaacaattttagatgattcagcttttgttccattactgttgaactatatgaactattccattactgcagagatttaagtatctgttttaataagctctttttgttatttaaaggctgcccatgggtttctgcctagtggtaaagctgattgttaccctcctttgaaatcccttctagttctgagatgctttgagggtaactggattcgattttgggatatcttttctcacattcagacttacacttaatggtgttagaaatcaacaaaactcctttttaaaaagaaaagatattaagcctgcctacttctacaatgcattctgttacctatttgaacagtatgtttgtaactatggcaatgaagtcagtagataggaaaccagttattccttctacctttaaaaattttgagaacttgccaaccagggattaaagctattatcttgaacagagtccctaaagctagtctagtttttgccacatctgcaatgattattgtttaatttcaaaagaatcctcaggctctacaatctaggggtggtaaatgtgtttccactatacttgggaaaaggtcagtaggatgtgcatcctagggaagataaaatcgtatatggtaaaggcatttgagttaattttgcattatatctaggaaccatattatttaaaatttgaatcctattaatgctgagagatcctaagagctagtatgttgtaaaacctgccacctgaataaaatgaaaaaaaaagtgtttttttgagacagagtcttgctctgttgcccaggctggagtgcagtggtgtgatcttgggtcactgcaaactccgcctcccaggttcacgccattctcctgcctcagcctcccgagtagctgggaccacaggggcccaccaccgcgcccggctaattttttgtatttttagtagagacggggtttcaccgtgttagccaggatgttctcgatctcctgacctcatgatccgcccgcctcggcctcccaaagtgctgggattacaggcgtgagccaccgtgcccggccctaaaatgaaattattaatgttggttctgaaacagcctcttagcattcagattgtattttaaatacttaaacacaccaattgtagaaagcaaccctttatttttagcaagtttggtttactcttctcccatgagattttgtctttctacattaactagtaagacataaagatttgaaactggaactatattatactttttaaccaatctctgtggcttcactcatgaaatttacttcagttaatatgagactgggggttaagttgtaactaatatgcaaaattgctttgtatatttggtgattttgtaatgtaagtgaattgattcttatttcactgatactattaatcatgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgta

SEQ ID NO: 66256 - DNA, 2599 bp, Homo sapiens
acggccgctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcagacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgtttatcaaaaaaaagagaaaatgacaaggtgaagtatgaagtaacagaagatgtgtacacatccagaaagaaacaacaccagaccatgatgcattatttttgtgcattaaatactcttcagtacaagaagaaaatagcattgttagaacctctacttgggtacatgcaagctcagataagtttctttaagatgggttctgaaaatcttaatgaacaactggaagaatttttagctaatattggaacaagcgttcagaatgttcgcagggaaatggacagtgatatagagaccatgcaacagacaatagaggatttggaagtagccagtgatcccttatatgtgcctgacccagaccccaccaaatttcctgttaatcgaaatttaacccgaaaggctggataccttaatgctaggaataaaacaggcttggtgtcatctacctgggacagacagttttacttcacgcagggtggaaatttaatgagtcaggcccgtggggatgtagcaggaggcctggccatggacatagacaactgttcagtgatggctgtggactgtgaagacagacgatattgttttcagatcacctctttcgatggaaaaaaatcttcaattttgcaagcagagagtaaaaaagatcatgaagagtggatctgtacaataaacaacatatctaaacaaatatacttaagtgaaaatccagaggaaactgctgcacgagtaaatcaatcagctctggaagctgtcactccttccccatctttccagcagaggcacgagagcctgcggccagcagcaggacaatctcggccaccgacagctcgaaccagcagttcaggatccttaggatctgagtctacaaatttggctgccctctctctagattctcttgttgccccagacaccccaatacagtttgacataatttctcctgtgtgtgaagatcagcctggccaggcaaaagcctttggccagggaggcaggcgtacaaatccatttggagaatctggaggaagtacaaaatctgaaactgaagattctattcttcatcagttatttattgtccgattccttggttcaatggaggtgaaatcagatgaccatccagatgttgtttatgaaactatgcgccaaatcttagctgcccgggccatccataacatctttcgtatgacagaatcgcatttattagtcacttgtgactgtttaaagttaattgatccacagacacaagttacaaggctcacgtttccattaccttgtgtagttttgtatgctacacaccaggaaaataagcgcctttttggatttgttcttcggacatcaagcgggagaagtgaaagtaatctgtcatcagtctgctatatatttgagtcaaacaatgagggggaaaagatatgtgattctgttggactggcaaaacagatagctttgcatgctgaactggatcgtagggcatcagaaaaacaaaaagaaatagagagagtaaaagagaagcaacagaaagaactcaataaacaaaaacagattgaaaaggtatacagtcctaatgtctggatctttatgtgttgtttgtgaagacttaattcagcactatgactttcagatttgaatttccaaatgaagggctgtttctgcttgttcagccacttcataaacagatgattcataccatagcagaaaagggtcacatctgttttttgatatgatgtttacattatagttacgttgacatgtaatatgactgtttcaaaaatataccagaactttaatatttcagaggaggttgtctctgtcaaagcagttgagaggctgtgtagacttaactgccattgctgaaagccattttgccttctatgggggggaaataaataaatatatatgttatatgaaatatataatgaaatgtatatttttaatattgccaggagtgtcaaatcattgtccatccaacagaataattttaaaagacaaatttcagagcaaaacttgaagaatg

SEQ ID NO: 66257 - DNA, 2057 bp, Homo sapiens
acggccgctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcagacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgtttatcaaaaaaaagagaaaatgacaaggtgaagtatgaagtaacagaagatgtgtacacatccagaaagaaacaacaccagaccatgatgcattatttttgtgcattaaatactcttcagtacaagaagaaaatagcattgttagaacctctacttgggtacatgcaagctcagataagtttctttaagatgggttctgaaaatcttaatgaacaactggaagaatttttagctaatattggaacaagcgttcagaatgttcgcagggaaatggacagtgatatagagaccatgcaacagacaatagaggatttggaagtagccagtgatcccttatatgtgcctgacccagaccccaccaaatttcctgttaatcgaaatttaacccgaaaggctggataccttaatgctaggaataaaacaggcttggtgtcatctacctgggacagacagttttacttcacgcagggtggaaatttaatgagtcaggcccgtggggatgtagcaggaggcctggccatggacatagacaactgttcagtgatggctgtggactgtgaagacagacgatattgttttcagatcacctctttcgatggaaaaaaatcttcaattttgcaagcagagagtaaaaaagatcatgaagagtggatctgtacaataaacaacatatctaaacaaatatacttaagtgaaaatccagaggaaactgctgcacgagtaaatcaatcagctctggaagctgtcactccttccccatctttccagcagaggcacgagagcctgcggccagcagcaggacaatctcggccaccgacagctcgaaccagcagttcaggatccttaggatctgagtctacaaatttggctgccctctctctagattctcttgttgccccagacaccccaatacagtttgacataatttctcctgtgtgtgaagatcagcctggccaggcaaaagcctttggccagggaggcaggcgtacaaatccatttggagaatctggaggaagtacaaaatctgaaactgaagattctattcttcatcagttatttattgtccgattccttggttcaatggaggtgaaatcagatgaccatccagatgttgtttatgaaactatgcgccaaatcttagctgcccgggccatccataacatctttcgtatgacagaatcgcatttattagtcacttgtgactgtttaaagttaattgatccacagacacaagttacaaggctcacggtgagttccacatgatttaagctttgttttaggtccctttgtatatatacacatcttacaacttgataataatcctgatcctgtatattcaagtgtgatagtatcagctatgattggtctttggctgttgtagttaagtctatggccatctccaaaaagttgtcattgaacattttatgtaacttaaaagaattaacacaattcttttt

SEQ ID NO: 66258 - DNA, 1051 bp, Homo sapiens
acggccgctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcagacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgtttatcaaaaaaaagagaaaatgacaaggtgaagtatgaagtaacagaagatgtgtacacatccagaaagaaacaacaccagaccatgatgcattatttttgtgcattaaatactcttcagtacaagaagaaaatagcattgttagaacctctacttgggtacatgcaagctcagataagtttctttaagatgggttctgaaaatcttaatgaacaactggaagaatttttagctaatattggaacaagcgttcagaatgttcgcagggaaatggacagtgatatagagaccatgcaacagacaatagaggatttggaagtagccagtgatcccttatatgtgcctgacccagaccccaccaaatttcctgttaatcgaaatttaacccgaaaggctggataccttaatgctaggaaatcatgatgctcgattaatagatatagccgtttat

SEQ ID NO: 66259 - DNA, 150 bp, Homo sapiens
aaattcttgctttagtacgtttgtggaaaggtgcacatgtgaagaccattgaaagcatttgtaagttttgaaaagtactgttgtattgttaacactcatttcttttttccagatcatgatgctgcgattaatagatatagccgtttatca

SEQ ID NO: 66260 - DNA, 445 bp, Homo sapiens
ggggcgggatttcccgcacggccgctcggcgcctggagaaggctgtgcgggcggggacggctgcagcccttgccggagagggcgggccggggtcagctgcggcgggcgggccggcgcggggagctgtgggcggcagctgcgtctcctgccaccgccctccctccgccacgatgccggggatcgacaagctgcccatcgaggagacgctggaggacagcccgcaggtgaggcgcgggagctggtgggcgacgagggagagcccagctggccgaccccaggtctggcgcctccgcggctcccgcaggtgcccgccccggcccaggtgggggccgccgccgccctaggtcaccgcccgtcgcaggccgcgcccggagttgtggaggctgggcccgccgcccaaggcccgcgtgggcctgctcggctgggccgagggccgcaggcggag

SEQ ID NO: 66261 - DNA, 408 bp, Homo sapiens
gagactgtatctcaaaaaaaaaaaaggaatccaagatgcttgattttccaagaatgttaactaaaatagtatattagctctttcatattagcaagtaaataaaatgattttgctaagcaaggttaacagtgatactattaccaacatagcatttagaatttggataattgtttaccattgaatataaactgttgatgtgctttcttatgtataaatgcaaaaaaatattgaaaggttaccatgtgatattaactgaaatgtctaaaatttaaagttatttcatatttaattcattagttttattcatctgttctttaggatcgtagggcatcagaaaaacaaaaagaaatagagagagtaaaagagaagcaacagaaagaactcaataaacaaaaacagattgaaaag

SEQ ID NO: 66262 - DNA, 277 bp, Homo sapiens
gctattcttcgggacatcgctattgatcggcacctcgctattcatcggcacctctctattcatcggcaccagtgcagtgtacaattcaaaatcatgcaatgtttcactttagaattggatttgaagaactcgactttatgtgatcatggtattggtatacatgtggggtggagaacttattttttcattttgtcacaataggtatatactgacaaggcttcaggaaaaaagttgttagaagattttttaatgtataataaagtccatgatttttgta

SEQ ID NO: 66263 - DNA, 404 bp, Homo sapiens
tgctttggacaaatggacctgcggtaggagagagggacaacagtaggagcaggcagatcttgctgtttcaaccaaaacctcatgctgaccagagttgaggaacagaagaagatggtgaaggcctgcaggtataggtgttcagcatgtcatctgaaatattccccacagaggcaaaaagaaaggaaattatctctgaaaaggaatgggaggacaagtcagcagaatatgtcaatgttttggttgaagaagctgcttgaatctgggcttttctgtgccatgtgttctcccagggccagcacaaagaagggcttttggtgcaggcccaagaccaccataatcatcattgattattcctctccacgccagtgtctctaaataaactttctcttctttctctgaaaaaa

SEQ ID NO: 66264 - DNA, 432 bp, Homo sapiens
caggctttctgtgctcatggcttgtcttctttgtgctgtagagcctccctctaatcttgtccatgcagtaaagagagatcacacaaaccctggacctacctctttgaggtggtactctcaaactctttgaaggtctgtatttgatggaatctctgggaaactgagttgggaaggtccctatatgaaaaacacgtgggttcttggagtgtacatctttaattttcttatttgtctctttagtcagcagaatatgtcaatgttttggttgaagaagctgcttgaatctgggcttttctgtgccatgtgttctcccagggccagcacaaagaagggcttttggtgcaggcccaagaccaccataatcatcattgattattcctctccacgccagtgtctctaaataaactttctcttctttctctgaaaaaagtg

SEQ ID NO: 66265 - DNA, 616 bp, Homo sapiens
aagacacaagtattagagctaaaagtataaaacttagaagaaaacacaggtgtaaatcttcatgacttcatggattaggcaggggttacctagaatgacaccaaaatcgtaagctatcaaagaaaaaaatagatacattggacttcatcaaaactaaacaccttgatgttttaaagcacagcatcaaaaaagtaaaggcaaaccacaaattgttaaaaaaagtatttataaatcatatatttgataagggacttacacctagaatatatgaagatttatcacaacttgataataaaaggaaaaatgaccaaatggaaaaaatggatacaagccaggctcagtggctcacgcctgtaatcccagcactttgggaggccaaggtgggcagatcgcttgaattcagcagtttaagaccagcctggccaacatggcaaaaccctatctctaccaaaaatagaaaaaattagctgggtgtggtggtgtgtgcctgtagtccagctacttaggaggctgaggcacgaggatcacctgagcctgggaggtggaaggagcagtaaggcaagactatgccactgcactccagcctgggcaacacagtgagaccctgtctcaaaaa

SEQ ID NO: 66266 - DNA, 398 bp, Homo sapiens
aagggaatggaactgagcaccttcaaagtgttctttctgtgaacatccacagtacaaattctatccctcttcagccccccagccccgccccatatttcacctctaattgcacctccagaactgtaggctcaagaacatatctctttggaaaatctataacaatcttagaattaagaagaaaaaagtgatacatcctttggatgctgtaccagacgctgcgtgggaccctctggatgtcaaaataattgggcaaggctcctgctccccagccactcacagtgcagttggcaggacataactgccaacaattattacaaaacaaagtcacctgtgtcataacagggttaagtgcagggtgctgagggaggctggggagggtgactgacagccactgcctg

SEQ ID NO: 66267 - DNA, 220 bp, Homo sapiens
tttctgttgcatatcaaatgggatttattgacttccttttctcaaaaatgtcatatagaaaacatttctaccctctaaaaattactaataacattagcatcaatgatttacaagtagacacaagtaaggtgaaacacagattaactcataccatcaaattcatatggccaagtataatcccattatataactattttctatcactaagcatagtccagct

SEQ ID NO: 66268 - DNA, 356 bp, Homo sapiens
tgacatttgagaagggagaacaggattatggaagatcaggagtggaagtgaggaggaggggcattctaggcagaggggaaagcatgaaaatttgggataaaatgtttaagagacttttatgcagtggtttttgcggctacacaatgggttcattgaagaaggtggcagggattaaaagtgggaagatgggttggagaaaaggtaatttggtttgagattggccaagtgggcagggacagagacacttataagagcctttagggtataggatgaagcggtgtgaggtagtgagacgtgtctggagataagaggaggacagcaggtaggtctgggaacctacatcgagaggtaatacg

SEQ ID NO: 66269 - DNA, 591 bp, Homo sapiens
acataattcccctatgcacatacaggactgaactgtaaatctgcattagaatttcaagataatctgcctgggcaaggtgactcatgcctgtaatcccagcatcttgggaggctgaggcaggagggtcgcttatgcacagggtcaagactgcagtgagccgtgattgttctactgcaccctagcatgtgcaacagagcaagaccctgtcccccacaccccaaaaaagtttttcaaggaagcctaaaataatgaatctggcaagatagagtagaggccaggtgcagcggctcatgtctgtgatcccaaaatgtagtgttggcacaaacctttattgaagtataatttatattacagaaaggggtgcctaagtggttcactaaatttttcacaaactgagtgtatctatttaagcctcaccagactgagcaaccaacattatcagcactgagcagccccctcatgcccgcttctggtccatgcccatacccacccccaccccaggctgacagcatactgacatctaaccatatggactggagtttcttgtttctgtgctctgtataaagagaggacacacgggatgtgtaccta

SEQ ID NO: 66270 - DNA, 468 bp, Homo sapiens
agtttgagaccagcctgggcaacataatgagaccatatctctaccaaaaatacaaatgtgcaccaccatgcctggcaacttttcaaatttgttttattttttgtagagacagggtctccctatgttgttcaggctggtcttgaacttctgggctcaggggaccctcctgtttcggcctcccaaaatgtagtgttggcacaaacctttattgaagtataatttatattacagaaaggggtgcctaagtggttcactaaatttttcacaaactgagtgtatctatttaagcctcaccagactgagcaaccaacattatcagcactgagcagccccctcatgcccgcttctggtccatgcccatacccacccccaccccaggctgacagcatactgacatctaaccatatggactggagtttcttgtttctgtgctctgtataaagagaggacacacgggatgtgtaccta

SEQ ID NO: 66271 - DNA, 745 bp, Homo sapiens
gtggaggttgcagtgagccaagattgcaccactgcactccagcctgggcaacagagtaagactctgtctcaaaaaaaaaaattcttttggtgggttaatgttacccagaagcagatcatactgtgctcacacatcttctgtccacatcataccaatgctagaataaagggggtaaacagaaaaacaggttttcttgggaaatgacatatggaagttgctgcacaggggtctctaatggcagaggtgcctccagggggctttgatatgtcagcagtagcagcgcacactgcaatgccttccttgcttgtagtaagtggcctctgggttcttaaaacaagaccctattgtgtaagatgctggacttgggaaaaacccctggcaggggctgcattgaggctggtgactcctgttggggcattgtgtgctgcatagtgtaataggcagccactctaggcccagcatggtggctcacgcctgtaatcccagcactttggaaggccgaggtgggcggatcacttgaggtcaggagttcgagaccagcccggccaacatggtgaaactccgtctccactaaaagcacaaaaattagccaggtgtggtggcgggcacctataatcccagctactagggaggctgaggcaggagaattgcttgaacctggtggggcagaggttgcagtgagccgagataacgctactgcactccagcctgggcaacagagtaaaactccgtctcaaaaaaaaaa

SEQ ID NO: 66272 - DNA, 201 bp, Homo sapiens
attaaaatagaaattctagaagagaaaaatataatgattacaaacaagagctcagtagccaaattaagagcagaacagttttagctaaatagaagactacgaactaggagacagtagaaaatatatagacagaagaacagaggaacaagtggataggaaaagcaagttaagcaaaaacagtcaaacaaacaaaaaaaagcc

SEQ ID NO: 66273 - DNA, 395 bp, Homo sapiens
aactacttaaaaatcctgttccaacaatgtgaaatctgagttttttttacatccaaattttttgtttaagtcatagacaaaacatatgtgaacagactggttacgcaagtagaacgtagtaaatttttatatgggaacagttgcatcctcactactagtacaaaaaataaaaatttaagcaatttataatactcttcatattaacgaaatgtggatgtttttaaatgatgtccagtgataaggttttatgagagtagtatacttacacattactggcaatagtgtaaattgctaaactttagatggcagcatgactatatagctaatgaatacttccatagtttttgacttgtaactcaatttttatgaatttgtccttaaaatgtcaatcattt

SEQ ID NO: 66274 - DNA, 950 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (267)..(267): n is a, c, g, or t
  misc_feature (498)..(498): n is a, c, g, or t
  misc_feature (548)..(548): n is a, c, g, or t
  misc_feature (573)..(573): n is a, c, g, or t
  misc_feature (689)..(689): n is a, c, g, or t
naangngggcaaaggacatgaacagacacttttcaaaagaagacatacatgcgccaacaaacgtgaaaaaatgcccaatatcactaatcattagggaagtaaaaatcaaaaccacagtgagaatggcttacaccagtcagaatggctattattaaaaagtcaaaaaataacatatgctgacaagattgcagagaaaagcgaatgcttatacactgctggtgggagcataaatcagttcaaccgttctggaaagcagtgtggcgattngtcaaagatctaaaaacagaactacgatttgacccagcagtcccactactgagtattgtaagaatttgccagtaaagtgatctggacctgaagatttctttttcagaaggttttacctaaaaattaaatttaaaaaataattatagctttaaataattatacttttagggtacatacccaaaggactataaattgttctatcacaaagacatatgcacatgttatgttcantgcagcactattcacaatagcaaaaacatagaatcaagctgagtgcccancaatggtagaccgttaagaaaatgnggtacgtatacactatggaaaactatgcagccataaaaaagaatgagatcatgtcctttgcaggacatggatggaactggaggccattatccctagcaaactaacgcaggaacagnaaaccaagcaccacacgttctcacttacaagtgggagctaaataatgagaacagaagaacagaaatagaggaacaatagacactgggacctacttgaaggaggagagtgggaagagggagaggttcagaacaaaaaacctgtcgggtactgtgcttagtacctgggtaatgaaataatctgtacaccagacccccacgtcatgagtttacctatataacaaatctgcacatgtaccccgaacctaaaattaaaattttttt

SEQ ID NO: 66275 - DNA, 470 bp, Homo sapiens
tgccaggcggcgccccgcgggctgccgccgccgctgccttgaagaagcagttcaacctcatcagcaggtggccgacctgactatgggccggtcggctctggaccgaaccacagcccagcccgaggccagcgggacgcccgctgccgctcaatcgccccctggtccttggcgaccatctgggacgggccgctgcctcctctgtagcaacccctcgggtgccccctgcccattgtccctaccccggcgagcattgccctgcgaggactacacccgatgcttctcctctcttccggaggacacagccagcctgggaccgctgccctgtgctaaaactccgatgacttctgtccctaacgctgtgccgagcgctgtgctgtggggggcagcattgtcagactttccgggttgacccgctgttgggagtcctttaagtgcatggtagcaagaaataaagggatatatgaaagcca

SEQ ID NO: 66276 - DNA, 2712 bp, Homo sapiens
  misc_feature (219)..(219): n is a, c, g, or t
  misc_feature (522)..(522): n is a, c, g, or t
  misc_feature (1208)..(1208): n is a, c, g, or t
  misc_feature (1242)..(1242): n is a, c, g, or t
  misc_feature (1573)..(1573): n is a, c, g, or t
  misc_feature (1803)..(1803): n is a, c, g, or t
  misc_feature (2238)..(2238): n is a, c, g, or t
  misc_feature (2461)..(2461): n is a, c, g, or t
  misc_feature (2574)..(2574): n is a, c, g, or t
gtggaaaaagcacttgaatctgtccaattgaatgaattgcactatgaattgaatgtgttactatccctttcacatcctatgtctaaaaacaaaaatgtttattaaacttctatagaatgattttcatcactatttccttggtccaaatacgtttataagggaattaaataacatagttggaaattttttaagccctcaattataatttttatacacatntaagacaaaaaagtgagtacctttgctaatcacttttaaatttcaaatcttaggtcaacctaagatttttttttacactaaaaatatgaagttaaaatcaaatgttattttaaaatcagaaatactattgatggatttaaagacaagtaattttaatgttacagaatattagtaatacaatcttaaagcaaagtatgtttttatgtctaacaactaacttattcagttaattgatttaatttgaaaggctgtataatatataagataataggtatgacagatttcctactaaggagacaaggncagggtagagcatattgctacagaaaagatagacattctttaaagtttcacttaaaagatctgcaaaagccaaaaagaaacaaaaagtcacagatttatagatgagcaatgtttgatatataaaataaaaatattgttaaattctgacaagaacatgaaaacaaagccatgattcacccaccggaagcattagagcatgttgggaatgcacaaaaattgatgcatcctcttttggtgatgattccaggcagagttgagtatcagtggccctagcaattatatgtaaaggcaatgctacttgcaagtttcccatcatataaaacctgtttatgatgttctgccaaatgaatatcactcttagatttaaacttgaaggtactctgaaaaaataaaactaaggtaaaccctgtttttaaaagcaacaattaaaaagccaaagttttaaagcagagaaacatttgcaataagaaagtacttgtgtacctttcatgtgtcagggactattcagtggtgttacttacttcgttatagtcacttcaattcaatgagagttaagttttattatgccaataaagatgctcagatcttcattttctaatttaaagtttttgattactggcaaaatcatttcattagaaaaaaatatcaaacctgattttatatataataggattgtacttgactanatcatagcataagtttaacttttcttgttaatantttaaaaagtatttatgtaaataaacagtgcctgacacgtgaattacttacaaaaaagactatcatttgaggctataaaaagttaatatgcaaaaatattcatatctttactaaaaagcaaatcaacctatgaaataccaatgctactcaacaataatatcacaatatacatactaaactcagaagataagtttgttaaaacatgttattactttttatgaaagacaactaaacatatgccatctataacaagaaaggtattgttagacgtggttaaaattgctctgcagatatgagtctaataatgataaatgatatttaacctttgcantcatcacatatcaatattactattactttcaacttacaactatgaaagcttaatgttaagaaattaagatttagaagggaaggggccagcatgtaattctaagtcttttgatttatagtccatattcaatgtatcactagtgaaatcatcttaaaatcctgactctgccactaatctttctcagcttaggaagtcatttagctgatgtggctccagttttctcactcaangttataatagggttaaatcaaatgtcccaaactcaagttcttacaggaggcacacagatatgcatgtaagcgaatttggccagatggggacttcctcaaactagagaatgtttgtccttcctaaaagtggcccctactcctcagttcaagtcaattgttcaatgttgctagttcttccatatttttcaagagaaacatgaaatccgaatttttatctaaaagcactatattttacaatttaattaaaacattttaacactgtgaagaccaatcatgtcagtttttacttctggactagtgtgtagagactaatacaaaactggatgcaaactattaattattaggcatgtgccaagacaagagcaacatgaataattaaaaatttgtgtatgctgtagtctgaagtatttcattgataatactttttttttgaangaggagggtagtgttatcactagaatgcttaagaactcagcatatctgcattcaaaaaaacaatgactgaattaaaacacacaagatatgttgttaaacactaaatcagctttccgtgtctgcattttacaaatgctgaaacatttgtacatcccattgtctagaacaaaactcctgctttcattttgttcatcttgcttacactggaattaacaagttttantatattatcttaaaagatttaaaatacttttgtggaaatgtaagatgtttaataaaacctattcttatttggaaatacattggtcttagtttttctgagtccatgatacatancataccctattttggtttgtaggaggaaaacaagtttatgtaatgaaatctaacactttcaggttaaaaaagtgtataatgtaatttaaatataaacatggaatccattaaataaaactaattttcttatctcccctt

SEQ ID NO: 66277 - DNA, 416 bp, Homo sapiens
atcaaacacacagatataaagcatgtaaagatgctgctatcttttagcaattgaaaaattaacatttcagaatgtgattagtgttaaagtggtttttgtcttgtgaacattgtgaaggggagaacgcatgggaaaggtctttttaaattctgtctgagacagtattcttagagttctgggttttttagtcttaaactaaaatgaattaagtctcaatttgctatcaaaatatacaagctgttatacattggccactaaggtgaagtgcaagcacacttgtgataggcgtattatgtgaagtcagaactttaaaaataaggaaacaaacacttttttgaaaggctggaaaaacttccttaacatttaaaaatagttcttaaacagagaaaaatttgtcaggtgattgattggcctta

SEQ ID NO: 66278 - DNA, 656 bp, Homo sapiens
ttggaaaacctttcgtgtatcataatgtgcctccttttgaaagactgaaaggaaaagttaatgtattatttcatttccatcctcagagggcagcaaaaggaaagtagttaaaagtgtctgtgatgatctactattaagtcaaaaggttgtaaatagttacaatcctaattcttttttttttctttgagacagagtctcgctctgtggcccaggctggagtgcagtggcacgatcttggctcactgcaagctccatctcccgggttcacaccattctcctgcctcagcctcccaaagtgctgggattacaggtgtgagccactgccccggccgtctccaaacttcttatttaaattgatgactaaaaattataacaccaagaagtgcctaccacttatcaggcatagtgtgagacactttacatcatctgtaatgctgtcaccaaaaccctgaaagttaggtattgggtttggtttacacacaaagaagctgaaactgaaagaggtagtttatcgagcatcacagagctagtagctatgattgtaaaccaaatatgactgattctacgatgtgctttctcttgccactgaagtagcaactcatgtttttatgagttgttttatgagtaacctatagtaagtagtttagttaatattg

SEQ ID NO: 66279 - DNA, 445 bp, Homo sapiens
tttagtagagacgggatttcaccatgttagccaggatggtctcgatctcctgacctcgttatccgcccgcctgtgcctcccaaagtgctgggattacaggtgtgagccactgccccggccgtctccaaacttcttatttaaattgatgactaaaaattataacaccaagaagtgcctaccacttatcaggcatagtgtgagacactttacatcatctgtaatgctgtcaccaaaaccctgaaagttaggtattgggtttggtttacacacaaagaagctgaaactgaaagaggtagtttatcgagcatcacagagctagtagctatgattgtaaaccaaatatgactgattctacgatgtgctttctcttgccactgaagtagcaactcatgtttttatgagttgttttatgagtaacctatagtaagtagtttagttaatattg

SEQ ID NO: 66280 - DNA, 632 bp, Homo sapiens
ttaaatagcacagaggtaaatgcacaaaggagggaggaattatcatagttttgaagagcatgagttctgattctagctcctccacttcctagctctgggatcctgagacaatttacttacctcttgtcatgtaaaatggcataataatagtgcccattcatagagatgctgtggttatattcagttattcattcaacaaatattcactgaggccctaagtgccaggcattatatctagtagctattcttgccttgtagaaattacagcagaatgggagagagattatgtacaattcattcaatttcatatgtagcaaatactatgaatggaatttacagggtgctatgagagcatatagtggcctaaaatgtgatgattctgtcagtaaacagctactgagcacctactatatactacttgtggttctaggtgctagggatatggtaaacagactccaagctggtctccaaccttccaacccatcacttttccacatagcagccataaacatttttgtaaataaatattacattatatcacccaagtgctgaaactcttttggtgtcttccaattgcacttagaatctaatctcgctatggcagttacctgacccaacctggccctaccaag

SEQ ID NO: 66281 - DNA, 2830 bp, Homo sapiens
  misc_feature (1)..(2): n is a, c, g, or t
  misc_feature (11)..(11): n is a, c, g, or t
nntggtgtggngtgtgtatgtgaacatgcgtgctccctgcgctgccggctctggctctcccccatccttcctcacagagcagcgcaggtttggccacagatgtcaggagcccgcggcttccctgctgagctaagagccctcttcaggccttgtggtgtcactatagctgacagtgtcaagtctcacgccctttacgaagcagagaggggttttgatgccgcattgtttagcagtatgcagacctctccctaggggctgtagatttcctgccttctgaacaatctcgaggggagcgtggatttccgtcccggcggcaccctcgggttttccctcccctgccccctccgccgcgctctcccccttcgcacattcggaaaccctcttgggagctgaatcatgttctcgccttttttggtcctagttgagctctcttccactttcatcaccagaggcttgagatctgtgaaagaatcagttcctcgcaggctgcggtctgcgccgcgcctcctttgtatgtcacgctcagagaggagcagtgcccttggagtgccctgctcttgctgagagccgcacgatagatgtctttgaatgactgactttaattaaagtgtggcgggctggagataaaatgattctgaatatcttatttggggggaaaaaaaagccagcttctttcttaagggagaaaaaaaggactccagcgccaggagtctcttcggtatccctgagagtcgggggaactctttaaatgcggcccttgatggtgttgtggagggagagtgaattctgggaatctctcagcagctttttgccaaacagatgggccaggagccgcggaaccaggctgaggaatgttgcctcacgatctcacatatccattcctggcacccaccagcccagggaatgcctctaccagttgtcagcgagaggcttacacagcatcttaaataaaagggattattgaaccaagaggccagggactgatggaaatgcccaccttgctggctcattgaaaaagtttggcaaggttgtcaggagacatgaattagatgggcttgggtcttgtgccctttgctaaaccaagtgctgtattgggaaagagacggggagagaagtgttggagatgctctttagtcaggcctgagtcacttgcccaaccctggagttggagttggggatggagccaggatctccaaaccacatgcccctagagtttcagggaaaatatggattgtgaattgaagatggggggtgatgtaaggcagacaaggacagaaaatccctcttccagctgtgatttggctgtgagtttggcgctcgagacaccatacgctcctgaggtttgttaaggggtttcaggatattgtggacaaaagggaatagcaaacgatgttcagtccataagtaccatttggaggaggaaataattgaaattgctgctgatcaaaaagctttttgtctccagtttggatgttggagacaggtttctgtgtaagagagtgagggtgtacaacatgactgagaaagaaaacaatgagttaaggcacataagtgcgcatgggtgtcacctggaggccttcttataacacagatggtcaggcccaccccaagtttctcatgcagtagaggtggagctcaagaatttgcatttctattttactttatttatttgctttatttatgtttgagacagggccttgctctgttgcatgggctgtagtacagtggtgcaatcatagctcactgcagcctccaactcctgggctcaagtgatcctcccaactcagcctccctcccaagtagtgaggactacaatcacacgccaccatgcctggctgtataatttgcacttctaaggtgttcccaggtgatgctgatgttgctggcccagggaccacacattcagtactgctgttaaggcaaaagacttaaacactccatatatgaaagaaagaaaaagagagagagagagagagagagagagaggaaggaaggaaggcaggcaagcaggcaatgcttcaataaatccattaaaacacattcaaacttcagaaataaacgtgttcaaataagaccagcagtccttggtggtggcttatcatttcacccatttgacagttttaaaagattgaccgaactcagtattgattaaggtttaggggaaaggctgtctcatatactgtgtttacaaatgtgaatgagtacagcctttccagagggcagtttggctatgtgtatcaaaatataaaatgtgtttgttttgacactacaatctcacttctagaattttactctaagaaaagataagtgtgtgaaaagaaatttaagtgtgtgaaaagatgcatatgcatgggattgctcatcacggtttcatttataatgaggaacagcaaacccgttaaatatccctccatggggagcaagtcaggcaaattctgtacagacacacaaaggcatgttatgcagtgaagagaaggaggcacatgtgggttctgcagagaggcagatcccaatgaggggtcaggacgggtcttggctgcacatcctggtttcctcttcatccatggggagcagcaccttatgaagaaaacaagcggcataatgaataaatactcacctctagcaaaagataatatgtataattaaatcaataaatattaatttgttaaatgttaataaatgtaaataaatattcatatatattaacgtgttgatttaaatattactattcattaatataaacaataaattgatacttgttaacattaaatatcaataaattttatgtattaatataaataaacactaataaaacaaatatttaaacatg

SEQ ID NO: 66282 - DNA, 2489 bp, Homo sapiens
aaatatttctttcactaggaaaaatagattcggaaaccctcttgggagctgaatcatgttctcgccttttttggtcctagttgagctctcttccactttcatcaccagaggcttgagatctgtgaaagaatcagttcctcgcaggctgcggtctgcgccgcgcctcctttgtatgtcacgctcagagaggagcagtgcccttggagtgccctgctcttgctgagagccgcacgatagatgtctttgaatgactgactttaattaaagtgtggcgggctggagataaaatgattctgaatatcttatttggggggaaaaaaaagccagcttctttcttaagggagaaaaaaaggactccagcgccaggagtctcttcggtatccctgagagtcgggggaactctttaaatgcggcccttgatggtgttgtggagggagagtgaattctgggaatctctcagcagctttttgccaaacagatgggccaggagccgcggaaccaggctgaggaatgttgcctcacgatctcacatatccattcctggcacccaccagcccagggaatgcctctaccagttgtcagcgagaggcttacacagcatcttaaataaaagggattattgaaccaagaggccagggactgatggaaatgcccaccttgctggctcattgaaaaagtttggcaaggttgtcaggagacatgaattagatgggcttgggtcttgtgccctttgctaaaccaagtgctgtattgggaaagagacggggagagaagtgttggagatgctctttagtcaggcctgagtcacttgcccaaccctggagttggagttggggatggagccaggatctccaaaccacatgcccctagagtttcagggaaaatatggattgtgaattgaagatggggggtgatgtaaggcagacaaggacagaaaatccctcttccagctgtgatttggctgtgagtttggcgctcgagacaccatacgctcctgaggtttgttaaggggtttcaggatattgtggacaaaagggaatagcaaacgatgttcagtccataagtaccatttggaggaggaaataattgaaattgctgctgatcaaaaagctttttgtctccagtttggatgttggagacaggtttctgtgtaagagagtgagggtgtacaacatgactgagaaagaaaacaatgagttaaggcacataagtgcgcatgggtgtcacctggaggccttcttataacacagatggtcaggcccaccccaagtttctcatgcagtagaggtggagctcaagaatttgcatttctattttactttatttatttgctttatttatgtttgagacagggccttgctctgttgcatgggctgtagtacagtggtgcaatcatagctcactgcagcctccaactcctgggctcaagtgatcctcccaactcagcctccctcccaagtagtgaggactacaatcacacgccaccatgcctggctgtataatttgcacttctaaggtgttcccaggtgatgctgatgttgctggcccagggaccacacattcagtactgctgttaaggcaaaagacttaaacactccatatatgaaagaaagaaaaagagagagagagagagagagagagagaggaaggaaggaaggcaggcaagcaggcaatgcttcaataaatccattaaaacacattcaaacttcagaaataaacgtgttcaaataagaccagcagtccttggtggtggcttatcatttcacccatttgacagttttaaaagattgaccgaactcagtattgattaaggtttaggggaaaggctgtctcatatactgtgtttacaaatgtgaatgagtacagcctttccagagggcagtttggctatgtgtatcaaaatataaaatgtgtttgttttgacactacaatctcacttctagaattttactctaagaaaagataagtgtgtgaaaagaaatttaagtgtgtgaaaagatgcatatgcatgggattgctcatcacggtttcatttataatgaggaacagcaaacccgttaaatatccctccatggggagcaagtcaggcaaattctgtacagacacacaaaggcatgttatgcagtgaagagaaggaggcacatgtgggttctgcagagaggcagatcccaatgaggggtcaggacgggtcttggctgcacatcctggtttcctcttcatccatggggagcagcaccttatgaagaaaacaagcggcataatgaataaatactcacctctagcaaaagataatatgtataattaaatcaataaatattaatttgttaaatgttaataaatgtaaataaatattcatatatattaacgtgttgatttaaatattactattcattaatataaacaataaattgatacttgttaacattaaatatcaataaattttatgtattaatataaataaacactaataaaacaaatatttaaacatg

SEQ ID NO: 66283 - DNA, 1927 bp, Homo sapiens
  misc_feature (203)..(203): n is a, c, g, or t
  misc_feature (739)..(739): n is a, c, g, or t
  misc_feature (872)..(872): n is a, c, g, or t
  misc_feature (1537)..(1537): n is a, c, g, or t
  misc_feature (1920)..(1920): n is a, c, g, or t
tgtgacggatggctgtgcatctaatgtaactgcatctagatacattgtgaggggtaaataggttattttggaagaaggagaaatgtaatgcttttacctttggataaattgcatttgtgataacagtgaggtatcgaaatactaatgtattcatttaatagaatttattttacatgattgttttagatatggagggtatgtcngctgcctttgatgaattctcagttctttgggaaatttagtgatgtgcttatttatatttgtatatattaggcatatgccccttactgggtaattgtgaaaattaaaaacataaatatgccaaacacttggagcagtccatggcacatagtttacacttgataaatgttttttctgttcccacaatcatcaacaccatcattttaattttaaacctcatccttattgttatccatcatcatagtgatgatgcgctgaattcatgtgattatagtgggattcgaaaaaagaatttgggagacacttgaggttaaattggtgtttgcttgtactgaaggaggaaaaatgaagagactgtgaaaacttgatttcttgcttggatgacagcaggaatagtatccttaactgatttagagaatgtaggatggggaccgtttaggcaatagaaatataatgagactgctttaaaacagttattctaaactgtaattgtatattttgatgaaaatgtctaggacttaaattgaaaaattgagantagaccttgggagagagagaaataggatggaaataaagctttaggagttattaaggcataaatggtgtatgacattgtgaataggtgagactatacaaagatggatggtagaggaagaagacatgaataatgntgatggagtataaagtctgagcagaaataaaagaaactgagatgagtccatgggagagagagaagataaagatgacggagttttcagaggaattcatgctgggaatttctatttaaaatgagtgagaaatattaaaggacaaaatagtcaaacagcaaggatttggtgactcaagcctggaactaaggtgagacatgagaaagaatacaactggagaatcactgggaatgaggtgaaaaaagatgaaattatagagtataactttaagaagcttaaaacagtagaaattctgtcataaagccctgggaaatgaccacactttggaaatgggagaaagaagagtggaaaaaagaggtagttacaccaaaacagttctaggagataaatataatttttcccttttcacaaatggaagctgaagttcagtgaaggaaagaatgaaagtgctcaaatagaaggggtgtgtctgaagaagatgaggacttggattcctagagtaactttaaagagcagaaatgcagatttatctttctggaaggaaaaatatgagtgagtgtaatgacaaattcgctggattacagagagtcggtaatggagctcttcccagctggatcttcgaagcaaagggtgagtttatttggctaagagtcaagatggagctgtgngtggagtgttgaatccatgaaacataaataaaaagatcggctagccgcagctgcagtgaagttaggcaagagatagtgtcagtgaatgtgggaaagcactaggaaaaaaataaaacgcactttgggaggccaagacgtatgggtcacctgaggtcaggagtttgagacagcctaggtcaacatggtgaaacccagattctactaaaaatacaaaattagctgggcgtggtggctcgtgcctgtaattccagctacttgggaggttgaggcaggagaatcacttggacctgggaggcggaggttccagtgggccgagatcacgccattgcaccccatcctgggcaacaagagcgacaaaactccgtccccacccgccaaaaaanaaaaaaa

SEQ ID NO: 66284 - DNA, 378 bp, Homo sapiens
ctgagcaaaagccagtaagtcagatactaatgaatggattagcaaattatagggactaatgaaattaaataaagattattcaactaaactagtggctcctcccagtagtttagagcgttgctgaccaccttctttttgtccactcacatattagaattaaaaatgtcaaagtaaaattaaaataacattctcacctacaagaggtagggagaaggaaagtaatatttatctttaatgttattttcagttgtgcatttattatgtatatttttgcataaaataacttgtagtttttgtttggacaagccaatcaaatgagtctttaagatgaagaaggagagcgaacccacaagagatgagtttcgtatgtcttctcaa

SEQ ID NO: 66285 - DNA, 322 bp, Homo sapiens
cctaactttcaaaatattctttcttctttgctataaattgctccatgctgcatctccattgctgtgtttctcttgtttaaattctttaaactaagaatacaagaacccaactttcacaacagccatcaacacacgtggcaattttaaaatgtgttcacagttctttgatactcttccagtattcttcccttttctcttgaatgtggatgtactgagtgactcgcttctaaaggacttagtgtggtataaatgagtatgtgatttcagagagtagttcattaaaaacacactgccacttcagcctcccttcagtccctcgttt

SEQ ID NO: 66286 - DNA, 456 bp, Homo sapiens
ttagcctcccttgttcccctctctgttaggtcctacttctggccttcatgtgctcatgaagcctaggagggcctggccctgcaggacacactagccagcctcactctcttcaagaccaagaggctgagtagacaaggaggctctggggcccaacaaggcccaggagtcattctctcactgtgtgtgtccccacctgtccttctctgtccctgccacactcccacctacctgcccctaaacatcccctagggcccttctgtacttctctctctatggagaagcagtttagcaaagtagttatgagatcaggctctgggctgggacttgacttgactcatgcctgtaatcccagcattttgggaggccaaggttgttggatcacttaaacccaggagtttgagaccagcccgagcaacatagtgagactcctgcttctggctctaccacttaccagtt

SEQ ID NO: 66287 - DNA, 182 bp, Homo sapiens
acattgcaatcacttttcaacgtgagatttggaggggacgaatattcaaaccatatcagtgcccacagtggcaactggcttgctaacataccccacattgttgcccccatcccctgcctcacttccccgctcccctacctatgtttcctgggatcaaactgcaaataaactgcttccactca

SEQ ID NO: 66288 - DNA, 358 bp, Homo sapiens
gcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatagaaggttaaaaaaaaaca

SEQ ID NO: 66289 - DNA, 733 bp, Homo sapiens
tttttttttttaaataatggctgtttttccaatctggcattttgtaatgtcactaaagttcacttcaaaatgcaaatatatcctaagacaataaccagctgtccctgcggtcatgtgaggtggtacttttcaagctcaatttggtttctggatgcattcttctaaattattttttatatacactgtaaataagtacatatgtgtatatatgtaaatatgtgtgtgtgtgtatgtgtgtgtgtgtgtatatatatatattactttatctctatatctacgttatccaggatactttggctcaacatttcttaagtcaaattttgcagaccagtcaatattcatcaaactactttaagatggagccaagtggcctacaagagaatactgctaaggctgttaacacatataatttatgcaggagaatattccaagcttcctgactgcatcacacttttaactttttcttacattcgaaactacacttagaatcataacaaacttcatttttcaaacgtttgactttgaggtgtgtacaagtatactctgactctataaacttactcttctttaaagcagatcatcctatttatcataagattattaaaaatgtatacctttgcttttatttgccataaaaaaagctttctttggaataaaatagatttttatccaaagatgcagaactgttttcaagataaatccaatctgatcaatttgacagattaagactctc

SEQ ID NO: 66290 - DNA, 374 bp, Homo sapiens
ccactgtgtctggcctgccatgagctttagaagccagaaagctgcacttgttaaaattgtttgtaaagtaagaataaaccatctatgaaaatgaattctatgaacaaaaggaataagctttagaaagcttggactttgcaaaatatagtcttgtttcaaacagctcttttttggctttttaaaaactcctggtctggtgtggtggctcacacctgtaatcctagctctttgggaggccaaggtgggcgaatcacctgagattaggagttcaagaccagcttggccaatgtggtgaaaccccgtctctactaaaaatacaaaaataagccaagagtggtggtgtacacctgtaatcccagctactcaggagtttg

SEQ ID NO: 66291 - DNA, 311 bp, Homo sapiens
cattccactgcactctagctggggcaacagaatgaaactccgtctctaaaaaataaataaaaataaagacttccatgtctgttattgttttctctaaattcaaaattcagtatacttttggaggcattacctcaggactaaatggaatgtaaagccagtcattctaaatggagatttgggcctaacgtgggaagacaatttggggagataatagtaaatctgctagagaaaaggtgacttcttaactggctccactcatattatttaaaaatatatctttcttcctatatggtcgtggtgataataaaatg

SEQ ID NO: 66292 - DNA, 502 bp, Homo sapiens
gtgatcctcccacctgagcacccacaagtagctgggactgcaggtgcacacaccaccacacccagctagtttgttattttttgtagagacaaggtcttgccatgttgcccaggctggccttaaacccctgggctcaagcagtcctcccacctcggcctcccaaagtgctgggattacaagtgtgagccactatgcccagcctacactctttttccaaataaagtcacatccccaggaactgggccttcagacatgagcgctccttggtgagccaccgttcacccgttacggtcctccaaaccaaatgcctggttcttcgttgctgttttccaaatgctacctccttactggctgactagcaatggggagtaaagcccacctctgctcctgcctctctgggaaagtattgcctccttggtctctggttcccatctccaaaagaagctttaggctctccccccgctgtgacttgctgtcatcatggaacagatttttgttgtgc

SEQ ID NO: 66293 - DNA, 609 bp, Homo sapiens
aaaatcctattctagggaaatcccttccatgactcttgctaatgacggtatttgtagacccttctgccatttaatgtcctggtgccttggaagcgctcagtcaccttgtgggtgacgaggctgctccagaatgtagtttgcttagccttgctcatcctagtaccaggcctttatggatgcagattttggaataagaaaataagtgaaaagaaaatctaatttcttgatctgattgaagtaagagaggaagctagatagatatcttttttttaaaaaaaaaattatactttaagagaattttaggtgcattattcttagtttgtgacaaaaatgtgatatttctactttatatgttttattaagtataagcagaacataattatttactagtatggttactaatgagcacattgctatttattttatatatatatatttatttttttctttttaaaaatttcttaactgagagtatgtgcaattattgactactttgcagaactggtggcaaatataatttgcatggtagtatgcatgaaaacaattgaatttgaataattttaacttttgttaagtaagtggttcataataaaagttatgtatttgtca

SEQ ID NO: 66294 - DNA, 380 bp, Homo sapiens
gaacacatatctctattcagccatacaaagtgcaactcaccttaaaaaaaaaatcctcaaagtaagccactgaaattaaaacttgaaatattcaaatacatatatcgcttttaaaaattgagaatatgtagtagttcctctgctgtaagatttgtatggaagaatcataatagcttctctaagtagctgatgttgactttaatcattcatttaacaaatctttattcgagcaacaatcataagccaagcatagttttaggtgttggaatacactaacaaaacaggccaagtttctgcttttgtggaactttaattttaattgcagaaccagaaaatcagtaaatcagtaaatgcataacataaaaaatggtgcaaagggg

SEQ ID NO: 66295 - DNA, 300 bp, Homo sapiens
cttctcatgccagtctaatgattgtttttagaaaaggatatacattgaccttcaatgtaataagaaatgcaacactttacggtgtccaactgctaagatttatttccaacttgtcagacacaactattttgcccaatccaaatcaaagggaatcaaggctgtgaaatccacacaggacatcaacgcacacataaatgaaaactacagatgtgtcagaggcaaccatatacacacaaataatgtaactactaaattccatgaagtagctgtccaggaatactttccaaataacttcagcaa

SEQ ID NO: 66296 - DNA, 571 bp, Homo sapiens
ggtggcaattgaacaatgagaacacatggacacaggaaggggaacatcacacaccggggcctgttgtggggttggggtcgggggagggatagcattaggagatatacctaatgttaaatgacgagttaatgggtgcagcacaccaacatggcacatgtatacctatgtaacaaacctgcacgttgtgcacatgtaccctaaaacttaaagtataataatgaaaaaaagaaaaacccatggatttgaaatgttgacagtgacagcgcagaaagttcaaggaaatattaaataaaaaaattgaaagccatgatagcaacagtaataacaagtgcctttgacatcattttttactgcttctgccactcgatctcctataagtcaccaagtcctgtgttaaatgtctcttaaatgtttcttgtttgggatgattaaaatcttttggaaatagtggcgattattgtacattataaatgtaatcaatgccactgaattgtacccttaataaggcaaaaagggcaaactttctgttgtatatattttaccagaataaatttttttacaagaaaaaaaa

SEQ ID NO: 66297 - DNA, 4957 bp, Homo sapiens
tccccgccccaggcgcacttctccaccagatgcagtcatctctgcgtcacacgtactgcaccgaatccacctcctctgctgtccatgctcacgatccagtggccaaggctatgggacttttccagcacaccacaaccctgactcccagaagccttcccgatacctttcacacccttctctctcacaccatgtgaaaacattctggggagcctctgcctctgaatcccctgcagaagtgcgcctgggtgcgcacccaggcgcacttctcacgcacgactcgctgctcgaggtgtgcgatgactacagcctcgacgacaacgagtacttctttgaccgccacccgggcgccttcacctccatcctcaacttctaccgcactgggcgactgcacatgatggaggagatgtgcgcgctcagcttcagccaagagctcgactactggggcatcgacgagatctacctggagtcctgctgccaggcccgctaccaccagaagaaagagcagatgaacgaggagctcaagcgtgaggccgagaccctacgggagcgggaaggcgaggagttcgataacacgtgctgcgcagagaagaggaaaaaactctgggacctactggagaagcccaattcctctgtggctgccaagatccttgccataatttccatcatgttcatcgtcctctccaccattgccctgtccctcaacacgctgcctgagctacagagcctcgatgagttcggccagtccacagacaacccccagctggcccacgtggaggccgtgtgcatcgcatggttcaccatggagtacctgctgaggttcctctcctcgcccaagaagtggaagttcttcaagggcccactcaatgccattgacttgttggccattctgccatactatgtcaccattttcctcaccgaatccaacaagagcgtgctgcaattccagaatgtccgccgcgtggtccagatcttccgcatcatgcgaattctccgcatccttaagcttgcacgccactccactggcctccagtctctgggcttcactttgcggaggagctacaatgagttgggcttgctcatcctcttccttgccatgggcattatgatcttctccagccttgtcttctttgctgagaaggatgaggacgacaccaagttcaaaagcatcccagcctctttctggtgggccaccatcaccatgactactgttgggtatggagacatctaccccaagactctcctggggaaaattgttgggggactctgctgcattgcaggagtcctggtgattgctcttcccatccccatcatcgtcaataacttctctgagttctataaggagcagaagagacaggagaaagcaatcaaacggcgagaggctctggagagagccaagaggaatggcagcatcgtatccatgaacatgaaggatgcttttgcccggagcattgagatgatggacattgtggttgagaaaaatggggagaatatgggtaagaaagacaaagtacaagataaccacttgtctcctaacaaatggaaatggacaaagaggacactgtctgaaaccagctcaagtaagtcctttgaaaccaaggaacagggatcccctgaaaaagccagatcgtcttctagtcctcagcacctgaacgttcagcagttggaagacatgtacaataagatggccaagacccaatcccaacccatcctcaataccaaggagtcagcagcacagagcaaaccaaaggaagaacttgaaatggagagtatccccagccccgtagcccctctgcccactcgcacagaaggggtcattgacatgcgaagtatgtcaagcattgatagtttcattagctgtgccacagacttccctgaggccaccagattctcccacagccctttgacatcactccccagcaagactgggggcagcacagccccagaagtgggctggcggggagctctgggtgccagtggtggtaggtttgtggaggccaaccccagccctgatgccagccagcactctagtttcttcatcgagagccccaagagttccatgaaaactaacaaccctttgaagctccgagcacttaaagtcaacttcatggagggtgaccccagtccactcctccccgttctagggatgtaccatgaccctctcaggaaccgggggagtgctgcggctgctgtcgctggactggagtgtgccacgcttttggacaaggctgtgctgagcccagagtcctccatctacaccacagcaagtgctaagacacccccccggtctcctgagaaacacacagcaatagcgttcaactttgaggcgggtgtccaccagtacattgacgcagacacagatgatgagggacagctgctctacagtgtggactccagcccccccaaaagcctccctgggagcaccagtccgaagttcagcacggggacaagatcggagaaaaaccactttgaaagctcccctttacccacctcccctaagttcttaaggcagaactgtatttactccacagaagcattgactggaaaaggccccagtggtcaggaaaagtgcaaacttgagaaccacatctcccctgacgtccgtgtgttgccagggggaggagcccatggaagcacacgagatcagagcatctgaactgccctgccttggaggagagacttttgggtgaggtccaaagaggagagctgttcagcttacctgccacagagcttttctgcatgaactctggaacagaaaggccctgtaaagccctcagagagaagagagactccagagaaggctccctaagaccttgagagccatgacaggtccatcagcatgaagttggccaagccatagggcacagcacctccttgtaacaactctatagccctctttgggagatgacatgagtggaactcacagccaccactaccaccactttagacaggaccgaggccacatactccccattctctcgtggctttccatctcagcctcggagggcaacattgacagtcctcctggcttcagctagagaaggatgctggaacaagcggctggtgttgaaagagtgggttgaccaatttggtattgaatgttgcccagccacccctaggaacacctgtccatcacctcctggatggattccactgttagacagctacagggaatgattggtcatggggaagtctctgcgccataagccacgatcccagcgcaaaacccttactcaaatgtcttcattgacttcggtatttcatagtacctgagattttattttgagataccatcagggtgagttgcaccacttgtactcaattctaattgccccctggcaatctgggaagggttcagaaggtgggcacccagccaacagcatgaactcagagcattgttttagggttggaggaggaacacgctttctttacatcactagtgtagactcaaaagatatgcaagtgtcaaatatgcaaaagaaatagtttattcaaagagactgtgtgttactgaagaacagcataaaaatatgatttttttacttgcaaaaatgaaaggaaaaaaataccacgcattgaaatgcccagttcagactgaataattcctgctgcagcaaggaaagtacctactataatagaaattctgttttgttttctgtggttttcaagttaaaaaaaaaaaagttaaaataaaaagcactttatgtttttcaaaaataggttctgccagggacagtgtcaacatcttgcactttaaaataagcactatttcccatagcccaattgttgggactgtagttggattgttgctacctgcccatttctggccagcatgggtaatattgtgctggtattactgtctgccatatcaaagtctgtgggctccttccctgcccctctgaaaccttcccttaaccctcatgggtcaggaggggttcttgccccttgggtggggcctctcatgaagtcaagtatacaggagacatgcacatctcaaaaggacacagtgacagttggacattgggtgttttactctgttctctttcttgtcaaccagctattggtttttcagtgtcactgtctgtactaaaagctcaactctccttcctgcagccatcgatgcagccagtacagacaaaagcaataagtatttgtgtgcatcctgagtggttctggtgtatttcttggtgttggttttcctgtcctcgtttgatgacctggcattgtcctgcctgcttttagtccaacagcatggtgttgttggccattcctcagtacagtggcattaggttgaaccactgatgaatacaatgctatagtgttggctcacctgtcagtaaagatgacatgttattggtctgcctgtctgtagtacaatggaacaatgttgttctcttaatgtaatgttgatggatgatgtcccaagtacaatagtgtagttctgtctatcctcaatacagtaacaggcatatgtcttcccagtggaagaaagatatggtattggttcacctagtcttaagtctcaatatcatctgttgctggtctgcctgttagtacaatggcatgatccacctctcagtacacaaatatcatggagctgttctgcctgctcttcatacataaggcataaggttgagccacctgccacacatatgatgagatgggatcattccaccacccttaaaaatatgtcttctctgctgtatacaaacccaattcataacacttctcagcatctccagagactgtagatccccccaagagggtgcagtcctgttctttgccgcattaacagagaaaacgagaacgtcactcttcctaggtatcttcagagtattcgcgcagcaactgcaaagggacttaggggcagggagagtgtgaggtcatcccgtgccaggcagaggaagcagcactcccaaaacactttgctgaacacgcagtctgagctgggggcctcttg

SEQ ID NO: 66298 - DNA, 397 bp, Homo sapiens
accgccacccgggcgccttcacctccatcctcaacttctaccgcactgggcgactgcacatgatggaggagatgtgcgcgctcagcttcagccaagagctcgactactggggcatcgacgagatctacctggagtcctgctgccaggcccgctaccaccagaagaaagagcagatgaacgaggagctcaagcgtgaggccgagaccctacgggagcgggaaggcgaggagttcgataacacgtgctgcgcagagaagaggaaaaaactctgggacctactggagaagcccaattcctctgtggctgccaaggtgagtctgggatctgggggctgctggtctggggggatctgcttgcatccccatattgaggaccactgctggaggactctggcttt

SEQ ID NO: 66299 - DNA, 5066 bp, Homo sapiens
  misc_feature (27)..(27): n is a, c, g, or t
  misc_feature (47)..(47): n is a, c, g, or t
  misc_feature (65)..(65): n is a, c, g, or t
  misc_feature (69)..(69): n is a, c, g, or t
  misc_feature (94)..(95): n is a, c, g, or t
cctgcccaggagcgccgccctggggcngtcgggatggaggtgagaanaggccgtgacgcgcgcgngggnccccctgcacccccagcagcccacnncgctccctgcccccctcccgcagcagcgggccttgccgtcgagtgacagcggcctggggggcagggggggcgggggcggccggatcagcgatgccggcgggcatgacgaagcatggctcccgctccaccagctcgctgccgcccgagcccatggagatcgtgcgcagcaaggcgtgctctcggcgggtccgcctcaacgtcggggggctggcgcacgaggtactctggcgtaccctggaccgcctgccccgcacgcggctgggcaagctccgcgactgcaacacgcacgactcgctgctcgaggtgtgcgatgactacagcctcgacgacaacgagtacttctttgaccgccacccgggcgccttcacctccatcctcaacttctaccgcactgggcgactgcacatgatggaggagatgtgcgcgctcagcttcagccaagagctcgactactggggcatcgacgagatctacctggagtcctgctgccaggcccgctaccaccagaagaaagagcagatgaacgaggagctcaagcgtgaggccgagaccctacgggagcgggaaggcgaggagttcgataacacgtgctgcgcagagaagaggaaaaaactctgggacctactggagaagcccaattcctctgtggctgccaagatccttgccataatttccatcatgttcatcgtcctctccaccattgccctgtccctcaacacgctgcctgagctacagagcctcgatgagttcggccagtccacagacaacccccagctggcccacgtggaggccgtgtgcatcgcatggttcaccatggagtacctgctgaggttcctctcctcgcccaagaagtggaagttcttcaagggcccactcaatgccattgacttgttggccattctgccatactatgtcaccattttcctcaccgaatccaacaagagcgtgctgcaattccagaatgtccgccgcgtggtccagatcttccgcatcatgcgaattctccgcatccttaagcttgcacgccactccactggcctccagtctctgggcttcactttgcggaggagctacaatgagttgggcttgctcatcctcttccttgccatgggcattatgatcttctccagccttgtcttctttgctgagaaggatgaggacgacaccaagttcaaaagcatcccagcctctttctggtgggccaccatcaccatgactactgttgggtatggagacatctaccccaagactctcctggggaaaattgttgggggactctgctgcattgcaggagtcctggtgattgctcttcccatccccatcatcgtcaataacttctctgagttctataaggagcagaagagacaggagaaagcaatcaaacggcgagaggctctggagagagccaagaggaatggcagcatcgtatccatgaacatgaaggatgcttttgcccggagcattgagatgatggacattgtggttgagaaaaatggggagaatatgggtaagaaagacaaagtacaagataaccacttgtctcctaacaaatggaaatggacaaagaggacactgtctgaaaccagctcaagtaagtcctttgaaaccaaggaacagggatcccctgaaaaagccagatcgtcttctagtcctcagcacctgaacgttcagcagttggaagacatgtacaataagatggccaagacccaatcccaacccatcctcaataccaaggagtcagcagcacagagcaaaccaaaggaagaacttgaaatggagagtatccccagccccgtagcccctctgcccactcgcacagaaggggtcattgacatgcgaagtatgtcaagcattgatagtttcattagctgtgccacagacttccctgaggccaccagattctcccacagccctttgacatcactccccagcaagactgggggcagcacagccccagaagtgggctggcggggagctctgggtgccagtggtggtaggtttgtggaggccaaccccagccctgatgccagccagcactctagtttcttcatcgagagccccaagagttccatgaaaactaacaaccctttgaagctccgagcacttaaagtcaacttcatggagggtgaccccagtccactcctccccgttctagggatgtaccatgaccctctcaggaaccgggggagtgctgcggctgctgtcgctggactggagtgtgccacgcttttggacaaggctgtgctgagcccagagtcctccatctacaccacagcaagtgctaagacacccccccggtctcctgagaaacacacagcaatagcgttcaactttgaggcgggtgtccaccagtacattgacgcagacacagatgatgagggacagctgctctacagtgtggactccagcccccccaaaagcctccctgggagcaccagtccgaagttcagcacggggacaagatcggagaaaaaccactttgaaagctcccctttacccacctcccctaagttcttaaggcagaactgtatttactccacagaagcattgactggaaaaggccccagtggtcaggaaaagtgcaaacttgagaaccacatctcccctgacgtccgtgtgttgccagggggaggagcccatggaagcacacgagatcagagcatctgaactgccctgccttggaggagagacttttgggtgaggtccaaagaggagagctgttcagcttacctgccacagagcttttctgcatgaactctggaacagaaaggccctgtaaagccctcagagagaagagagactccagagaaggctccctaagaccttgagagccatgacaggtccatcagcatgaagttggccaagccatagggcacagcacctccttgtaacaactctatagccctctttgggagatgacatgagtggaactcacagccaccactaccaccactttagacaggaccgaggccacatactccccattctctcgtggctttccatctcagcctcggagggcaacattgacagtcctcctggcttcagctagagaaggatgctggaacaagcggctggtgttgaaagagtgggttgaccaatttggtattgaatgttgcccagccacccctaggaacacctgtccatcacctcctggatggattccactgttagacagctacagggaatgattggtcatggggaagtctctgcgccataagccacgatcccagcgcaaaacccttactcaaatgtcttcattgacttcggtatttcatagtacctgagattttattttgagataccatcagggtgagttgcaccacttgtactcaattctaattgccccctggcaatctgggaagggttcagaaggtgggcacccagccaacagcatgaactcagagcattgttttagggttggaggaggaacacgctttctttacatcactagtgtagactcaaaagatatgcaagtgtcaaatatgcaaaagaaatagtttattcaaagagactgtgtgttactgaagaacagcataaaaatatgatttttttacttgcaaaaatgaaaggaaaaaaataccacgcattgaaatgcccagttcagactgaataattcctgctgcagcaaggaaagtacctactataatagaaattctgttttgttttctgtggttttcaagttaaaaaaaaaaaagttaaaataaaaagcactttatgtttttcaaaaataggttctgccagggacagtgtcaacatcttgcactttaaaataagcactatttcccatagcccaattgttgggactgtagttggattgttgctacctgcccatttctggccagcatgggtaatattgtgctggtattactgtctgccatatcaaagtctgtgggctccttccctgcccctctgaaaccttcccttaaccctcatgggtcaggaggggttcttgccccttgggtggggcctctcatgaagtcaagtatacaggagacatgcacatctcaaaaggacacagtgacagttggacattgggtgttttactctgttctctttcttgtcaaccagctattggtttttcagtgtcactgtctgtactaaaagctcaactctccttcctgcagccatcgatgcagccagtacagacaaaagcaataagtatttgtgtgcatcctgagtggttctggtgtatttcttggtgttggttttcctgtcctcgtttgatgacctggcattgtcctgcctgcttttagtccaacagcatggtgttgttggccattcctcagtacagtggcattaggttgaaccactgatgaatacaatgctatagtgttggctcacctgtcagtaaagatgacatgttattggtctgcctgtctgtagtacaatggaacaatgttgttctcttaatgtaatgttgatggatgatgtcccaagtacaatagtgtagttctgtctatcctcaatacagtaacaggcatatgtcttcccagtggaagaaagatatggtattggttcacctagtcttaagtctcaatatcatctgttgctggtctgcctgttagtacaatggcatgatccacctctcagtacacaaatatcatggagctgttctgcctgctcttcatacataaggcataaggttgagccacctgccacacatatgatgagatgggatcattccaccacccttaaaaatatgtcttctctgctgtatacaaacccaattcataacacttctcagcatctccagagactgtagatccccccaagagggtgcagtcctgttctttgccgcattaacagagaaaacgagaacgtcactcttcctaggtatcttcagagtattcgcgcagcaactgcaaagggacttaggggcagggagagtgtgaggtcatcccgtgccaggcagaggaagcagcactcccaaaacactttgctgaacacgcagtctgagctgggggcctcttg

SEQ ID NO: 66300 - DNA, 1397 bp, Homo sapiens
tccccgccccaggcgcacttctccaccagatgcagtcatctctgcgtcacacgtactgcaccgaatccacctcctctgctgtccatgctcacgatccagtggccaaggctatgggacttttccagcacaccacaaccctgactcccagaagccttcccgatacctttcacacccttctctctcacaccatgtgaaaacattctggggagcctctgcctctgaatcccctgcagaagtgcgcctgggtgcgcacccaggcgcacttctcacgcacgactcgctgctcgaggtgtgcgatgactacagcctcgacgacaacgagtacttctttgaccgccacccgggcgccttcacctccatcctcaacttctaccgcactgggcgactgcacatgatggaggagatgtgcgcgctcagcttcagccaagagctcgactactggggcatcgacgagatctacctggagtcctgctgccaggcccgctaccaccagaagaaagagcagatgaacgaggagctcaagcgtgaggccgagaccctacgggagcgggaaggcgaggagttcgataacacgtgctgcgcagagaagaggaaaaaactctgggacctactggagaagcccaattcctctgtggctgccaagatccttgccataatttccatcatgttcatcgtcctctccaccattgccctgtccctcaacacgctgcctgagctacagagcctcgatgagttcggccagtccacagacaacccccagctggcccacgtggaggccgtgtgcatcgcatggttcaccatggagtacctgctgaggttcctctcctcgcccaagaagtggaagttcttcaagggcccactcaatgccattgacttgttggccattctgccatactatgtcaccattttcctcaccgaatccaacaagagcgtgctgcaattccagaatgtccgccgcgtggtccagatcttccgcatcatgcgaattctccgcatccttaagcttgcacgccactccactggcctccagtctctgggcttcactttgcggaggagctacaatgagttgggcttgctcatcctcttccttgccatgggcattatgatcttctccagccttgtcttctttgctgagaaggatgaggacgacaccaagttcaaaagcatcccagcctctttctggtgggccaccatcaccatgactactgttgggtatggagacatctaccccaagactctcctggggaaaattgttgggggactctgctgcattgcaggagtcctggtgattgctcttcccatccccatcaaaacaataatttgttgcgtcaaaagaaggtgagaaaacggaaaaagaaaaaagataagaaagtaaaggggggaaaacaactaagaat

SEQ ID NO: 66301 - DNA, 3711 bp, Homo sapiens
gcgaggacagctgaataactgggagctcgaagttgcttgctgcctccgggagtggtctgcttggctgtcgcgttttccttttcttttttttttaaaaaaaaaaaagccaaacgtttgctcaccatcacctgcagaagtgagtttttattgaagaagctccagctgctttctccttattgccggcagcctggcaagcctcccttagagtgagctacttctcaggccgggcacgacagcagtgctagcacatttgaaaaagcaggaaaccgcccctgcatgcagagcttccagcctgagaaccccaggccagtcctcccagcagctgtgtagccagagagccttggtactgtggtcacatccctcaaaagtgaacagtcgccatcggaggcgtttggaggagaccgtgatgttgcagatgctgtggcatttcctagctagctttttccccagggctgggtgccacggctccagagagggggacgatcgtgaagtcagaggcaccccagcccctgcctggagagaccagatggcaagctttttggggaaacaggacggaagggctgaggccacggaaaaaagacccaccattttgctggtggttggacctgcagagcagtttcctaagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagaatacgaacgggccatttctggggccctgtcacctacatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtggggggctggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagct

SEQ ID NO: 66302 - DNA, 291 bp, Homo sapiens
ctttccaaccaggagcaccaatggctcttctctcgtttacaggatgtgcgagacgtcagcgccacgttcctttcagacctggaagagaactttgagaacaatatcgtcgtccttctagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaaggtaaggctggccctggacagtc

SEQ ID NO: 66303 - DNA, 3244 bp, Homo sapiens
  misc_feature (23)..(23): n is a, c, g, or t
ggtgagggcagtggagcacccancaggccgccaacatgctctgtctgtgcctgtacgtgccggtcatcggggaagcccagaccgagttccagtactttgagtcgaaggggctccctgccgagctgaagtccattttcaagctcagtgtcttcatcccctcccaggaattctccacctaccgccagtggaagcagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtggggggctggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagct

SEQ ID NO: 66304 - DNA, 1885 bp, Homo sapiens
  misc_feature (17)..(17): n is a, c, g, or t
  misc_feature (21)..(21): n is a, c, g, or t
  misc_feature (23)..(23): n is a, c, g, or t
tggctaggtacgaggcnggtntnatcggccgaggctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtggggggctggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagct

SEQ ID NO: 66305 - DNA, 4073 bp, Homo sapiens
tgccggcgtctccgagcccgcgctcccagctgcagagcgcctggcttgcctcccgcgcggtcaccgccggcccgccgcccccgctcccgcccgcgcccggagcccctgcctcgcgcccgatggtgagcagtgtgttgtgccgctgtgtggcctccccgccgccggacgccgccgccaccgccgcctcttcgtctgcctcatcgccggcgtccgtgggggacccctgcggcggcgctatctgcgggggcccggaccaccggctgcgcctgtggagactctttcagacgctcgacgtcaaccgggacggcggcctgtgtgtcaacgacctggcggtggggctgcggcgcctgggactgcaccgcaccgagggcgagctccagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtggggggctggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctaagcaattaaaccagttaagtctcccaaaaaaaaaaaaaaaaaaaaaaaaaaaaaaaaaaaaaaaaaaaaaaaaaaaaaaaaaacggcgacgccacacgacgacgacacacaaaaaagaagacactatataaacaacaacaaatcaagacgagagttgagcgagcgcgcgggcgccccccacaagagagagaaacaaagaaacgcgaggcaaaaaacggcggcgtctccccggcgagagcaacacgcggcgtgcgcaatcaataacaagaggggcgaggaggatctctcccccacccgccataaaataaaaaaaaaagagcgcgcggcgcgcggagcgctaacacaagcaccggagcgcgctctttatcaagagacaacatctcctccctaaaagagagcgagagtatctccttaccgagagaggcaagctctaatatagatgggagggagtctatctcttatcacaacgcagagagagcgcgtatcccacacagaattagatgcgaccgcctcgcagtagtatctctctgataactagataatctcagctcagcgccccccaccgtacgcggcagatgtaggtgggaggacacactagtcctaccgacgtcatcgcgtcgggtgaggtccggaggtgtgggg

SEQ ID NO: 66306 - DNA, 2427 bp, Homo sapiens
  misc_feature (2304)..(2306): n is a, c, g, or t
  misc_feature (2308)..(2308): n is a, c, g, or t
  misc_feature (2313)..(2314): n is a, c, g, or t
  misc_feature (2321)..(2321): n is a, c, g, or t
  misc_feature (2328)..(2328): n is a, c, g, or t
  misc_feature (2331)..(2331): n is a, c, g, or t
  misc_feature (2344)..(2344): n is a, c, g, or t
  misc_feature (2357)..(2357): n is a, c, g, or t
  misc_feature (2361)..(2361): n is a, c, g, or t
  misc_feature (2366)..(2367): n is a, c, g, or t
  misc_feature (2370)..(2370): n is a, c, g, or t
  misc_feature (2374)..(2374): n is a, c, g, or t
  misc_feature (2376)..(2376): n is a, c, g, or t
tgccggcgtctccgagcccgcgctcccagctgcagagcgcctggcttgcctcccgcgcggtcaccgccggcccgccgcccccgctcccgcccgcgcccggagcccctgcctcgcgcccgatggtgagcagtgtgttgtgccgctgtgtggcctccccgccgccggacgccgccgccaccgccgcctcttcgtctgcctcatcgccggcgtccgtgggggacccctgcggcggcgctatctgcgggggcccggaccaccggctgcgcctgtggagactctttcagacgctcgacgtcaaccgggacggcggcctgtgtgtcaacgacctggcggtggggctgcggcgcctgggactgcaccgcaccgagggcgagctccagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggctggtnnncnaaggnngctgggncctgggncgngtggctggcctgnggtggcccttacnatcngtccnnggngggngnggcccttttgggggcggggtttttgggggggggggggctgggggggggccg

SEQ ID NO: 66307 - DNA, 1451 bp, Homo sapiens
tgccggcgtctccgagcccgcgctcccagctgcagagcgcctggcttgcctcccgcgcggtcaccgccggcccgccgcccccgctcccgcccgcgcccggagcccctgcctcgcgcccgatggtgagcagtgtgttgtgccgctgtgtggcctccccgccgccggacgccgccgccaccgccgcctcttcgtctgcctcatcgccggcgtccgtgggggacccctgcggcggcgctatctgcgggggcccggaccaccggctgcgcctgtggagactctttcagacgctcgacgtcaaccgggacggcggcctgtgtgtcaacgacctggcggtggggctgcggcgcctgggactgcaccgcaccgagggcgagctccagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggagtttctgaatgtcaaggcagtgaggtgcctctcactgtgaatttgtggtgggcgggggctggaggagagggtggggggctggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagct

SEQ ID NO: 66308 - DNA, 404 bp, Homo sapiens
agagacggggtttcaccatgttggctgggctggtctcgaactcctgaactcaagtgatccacctgcctcagcctcccaaagtgctgggattacaggcatgagccaccgcgcccagccttgattttttttttaagtcatctttatggagatgttcaggacaaggctggcaaccagcagatacccagtacgatggagctgagcctcacttagccgtgttgggttactttgggctcatgattccaagcttgtcttcaaaatgcacggaagaaagggccttccctttggccgcagccggttggccagcagaggctcttggccgggtgaggcagcctgtggccccccgggtccgtctgactgttcggtcctccctcccaggtccatgcctcccgcagcaacaacatggg

SEQ ID NO: 66309 - DNA, 2748 bp, Homo sapiens
ttgtgccatctggcacgaggcacagatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtggggggctggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagct

SEQ ID NO: 66310 - DNA, 3430 bp, Homo sapiens
tgccggcgtctccgagcccgcgctcccagctgcagagcgcctggcttgcctcccgcgcggtcaccgccggcccgccgcccccgctcccgcccgcgcccggagcccctgcctcgcgcccgatggtgagcagtgtgttgtgccgctgtgtggcctccccgccgccggacgccgccgccaccgccgcctcttcgtctgcctcatcgccggcgtccgtgggggacccctgcggcggcgctatctgcgggggcccggaccaccggctgcgcctgtggagactctttcagacgctcgacgtcaaccgggacggcggcctgtgtgtcaacgacctggcggtggggctgcggcgcctgggactgcaccgcaccgagggcgagctccagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtggggggctggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagct

SEQ ID NO: 66311 - DNA, 1995 bp, Homo sapiens
  misc_feature (17)..(17): n is a, c, g, or t
  misc_feature (21)..(21): n is a, c, g, or t
  misc_feature (23)..(23): n is a, c, g, or t
tggctaggtacgaggcnggtntnatcggccgagggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtggggggctggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagct

SEQ ID NO: 66312 - DNA, 2938 bp, Homo sapiens
  misc_feature (2854)..(2854): n is a, c, g, or t
  misc_feature (2905)..(2905): n is a, c, g, or t
  misc_feature (2927)..(2927): n is a, c, g, or t
tgccggcgtctccgagcccgcgctcccagctgcagagcgcctggcttgcctcccgcgcggtcaccgccggcccgccgcccccgctcccgcccgcgcccggagcccctgcctcgcgcccgatggtgagcagtgtgttgtgccgctgtgtggcctccccgccgccggacgccgccgccaccgccgcctcttcgtctgcctcatcgccggcgtccgtgggggacccctgcggcggcgctatctgcgggggcccggaccaccggctgcgcctgtggagactctttcagacgctcgacgtcaaccgggacggcggcctgtgtgtcaacgacctggcggtggggctgcggcgcctgggactgcaccgcaccgagggcgagctccagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggagacgnaaatcaacatgaacataaatatgaataaaaaatgaacttgaaaatgacaantattaattaaacaaatctatanaaaatagttac

SEQ ID NO: 66313 - DNA, 2622 bp, Homo sapiens
tgccggcgtctccgagcccgcgctcccagctgcagagcgcctggcttgcctcccgcgcggtcaccgccggcccgccgcccccgctcccgcccgcgcccggagcccctgcctcgcgcccgatggtgagcagtgtgttgtgccgctgtgtggcctccccgccgccggacgccgccgccaccgccgcctcttcgtctgcctcatcgccggcgtccgtgggggacccctgcggcggcgctatctgcgggggcccggaccaccggctgcgcctgtggagactctttcagacgctcgacgtcaaccgggacggcggcctgtgtgtcaacgacctggcggtggggctgcggcgcctgggactgcaccgcaccgagggcgagctccagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccatcgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagtgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagctcatgatgctgatttgggcgacccaaacgtgaactctaatggggaggttttcctctatgcatttaaagtggcctctggatccccggccgagcttaaggcgcgcctataactcactgagcgagcagcactgtgacaagctcctggctgatcctg

SEQ ID NO: 66314 - DNA, 1418 bp, Homo sapiens
  misc_feature (94)..(94): n is a, c, g, or t
  misc_feature (99)..(99): n is a, c, g, or t
  misc_feature (108)..(108): n is a, c, g, or t
  misc_feature (117)..(117): n is a, c, g, or t
  misc_feature (708)..(708): n is a, c, g, or t
agcgggggcggggtcgggcgccgggcgggacccacgtcctctcgcgagactggggctggccgcgctggggaccccgctggagaaatttgcgccnagagngtgcggggncgccctggncgtcccgcccgtggccggcgccttctcggagcccagccattccgctagacccgaactaggactggtaggaggggtgatcggcccaacctcaggccccagccgcgggccgggaaggcttccccacggacgaggggcaagcccctcgacgtcagggtgtcgtctatgtagaggggaatctgcctcctctcaaaggggaattctttcagcgagtcaagcccgtctgattcggggctgactcagggcagaggcccagagaggacctggataggttgcgagaagtcgagatcagagggggcggaaggcagtgagaaaagggagacgagcatcggggggtgagagacaaactcaggtctggctcttggcccttgacgccactgaattcgcttcccacggtgggaagaggagaaaagggccctgacaccgcggctcgccaggggcccgctgcgtagctgcatcccgatcccgctgaggggacagcaaatagtgaagtgctgatagcttgtggttgtcgttacactggaaggaaatagaaaaccggacagtggtgtgtgtgtgtgcgtcttggccaaaggaacttcttgggtgggattncaggcgtgagccaacgtgcccagcctaaaccttttagacttcattaggattctggttggtaaagaacattaaaaatgacaagctcattatataggtgctaattttaattactttgactactgaacacacgccaggtactaacaaagaagggagtattcaccctggggatttaaatctgtgaaaaggtattaaaacatatataaaacataataaaatgaaatcccaaaggtctctttccatctgagcttactttccctaatttgggtttgtctcttaggtccaccgggcatacttagtatctttggacaaataggaattcaatgaaaacgtattcttaaaggcgaaaaaggtggatttgctaggtaagttgctgtttctcaaggaggtagcctgggtgctataaatccaatccaatctaatctaatctaataccatacaatataatacaatcgatacaataaaatcaatatcccaaggaaaacgcttagaaaattatttcatggcaaaataatttttcaaagttttcactgtgcatcttcctggttttagagtaggcacttatttttattttcactattgctctatttttagccataaccaccagtactgcagcaaatacttcttgagaattatcctatgtactttaaaatgaaaagtatctgcttttagagagcaaacctctaattgacgaaatatataattgctacatt

SEQ ID NO: 66315 - DNA, 788 bp, Homo sapiens
agcgggggcggggtcgggcgccgggcgggacccacgtcctctcgcgagactggggctggccgcgctggggaccccgctggagaaatttgcgcccttctcggagcccagccattccgctagacccgaactaggactggtaggaggggtgatcggcccaacctcaggccccagccgcgggccgggaaggcttccccacggacgaggggcaagcccctcgacgtcagggtgtcgtctatgtagaggggaatctgcctcctctcaaaggggaattctttcagcgagtcaagcccgtctgattcggggctgactcagggcagaggcccagagaggacctggataggttgcgagaagtcgagatcagagggggcggaaggcagtgagaaaagggagacgagcatcggggggtgagagacaaactcaggtctggctcttggcccttgacgccactgaattcgcttcccacggtgggaagaggagaaaagggccctgacaccgcggctcgccaggggcccgctgcgtagctgcatcccgatcccgctgaggggacagcaaatagtgaagtgctgatagcttgtggttgtcgttacactggaaggaaatagaaaaccggacagtggtgtgtgtgtgtgcgtcttggccaaaggaacttcttgggctgggttaatgtgagcaggtactcccttgggcgaagtactggcactggccaacggcctttccctctggccgtctccgaggaagcagagctgctgtgaagacagttcctctcgccaccgtgtgttcagttctga

SEQ ID NO: 66316 - DNA, 780 bp, Homo sapiens
  misc_feature (780)..(780): n is a, c, g, or t
cccagaggcggtcctgtagctgggccggcttggggcttggttctatgtccctgtgggttggtgcaagggccaggaggaacccgtgagcctcaggggatcccagggggccggaccagtgttccctagttgtgggaacagacgcgtgggcgcatcgcgggagggcagggcctgaagagcagctatgtttccagtgtcctctgggtgtttccaagagcaacaagaaacgaataaatctctgccataggagttttagccaattcagaggccttgctccctacaattggaacattcctttggatttgaccaagtcaggaagagatgggagaaaagtgaaacaacaacaataaaaccccaagcataaacaaacaaagagttaagcaaaacaacaaatgcacaattcatatgattactgagtgttctaatggtaaggagaaattaaaagcagaaattaaaaaaaaaaaaagaaaaaaaaaaaaaaaaaaagtttgtggggggggggggcgaaaaagttgtctgaaaccccctctctcgtggggcgcggggcccccattggtgaatggcacctggcccaaacagtggcccaagagaaacctggtccgcaattgtggcgggtgtcccccccattaaaaaaacgccggcggaacgggtgtgtttgacaaaatcccaaggttccgacggcctcgggtcctaccacggaggccagggagccgaataataccgcccactgggatggcaacaaggcagacgaacacagacaggaagaagacaaacgagcaggcn

SEQ ID NO: 66317 - DNA, 422 bp, Homo sapiens
cccagaggcggtcctgtagctgggccggcttggggcttggttctatgtccctgtggctatgtttccagtgtcctctgggtgtttccaagagcaacaagaaacgaataaatctctgacccttctcaggtgcagccagagagacactagcccactgatggacggacagacgtgggcagggtccgtgtcactaaaccacccaccactgccacagctgcctacaacagacacatcagatgacactccgggcatataaatgattttcactgaggacttactggttttaataataggtcctggtgtagagaagtccctcaacctattgtgcaatgagttttgagaagcgggtaagctgtatgttttgtggttttgtttcataaatgcatctacaggaagaccaatattgactgaatgaagctttcatt

SEQ ID NO: 66318 - DNA, 821 bp, Homo sapiens
ttgaattgtaaatagaatagaaattataaatgaacttttcaatagtaattattttttaatacgggtacttaaaattgtgtcaacttcttaacaaaagaaatggaggcaaaattagtataaacagtttatttgggccaaatttgagaactgcaatgtgggagacacgtcttcaagttgctatgaatataaactccaattagcagcagttacaagcggttttttttttttaaagaaggggcagttctttagttgcatataaactattgattggctatacatttttttttaaccataaattccaggagcatgaacataatgggtgagggtcacatcccctgggcatggatttggggcaggatgtgacaaaaatctcatactcatgtctctctgggcctgataaattttgcatactttatatagttcagactcttctgagctacgtttctttctcttccttttggttgagttttttttttcttctgaaagtattgatgatcaacattttagatgtaagtttgtcccatgtcactggaagacttagttttagttagtctcatcccacattggaggaagagaggagagataaaatggcttaagaatgcagtgaagtctcaaggccaagttgattggcaacacaaagggacagggcaatggtatttcaggtcatctgcttacaaaggagctatggcatgttggatcatttctaagcatctagctatcattattttagtgtttttgttgattttggacatctagaagtgcaaagtataatcaatttgagaataaaagacatgatgcaaataaagacaattactaacaaa

SEQ ID NO: 66319 - DNA, 448 bp, Homo sapiens
ccaaggtgggtggatcacttgagctcaggagttcaagaccagactggccaacatagcaaaactctgtgtctaccagcaacacaaaaactaggtgggcatcttgatgcatgcctgtggtccaggtacttgggaggctgagttgggaggctcacctgagcctgggaggctggggttgcagtgaggtgaaatagctgagattgtgctactgtactccagcctcagtgacaaagtgacacccttatctcaattaaaaaaaaaaaaagaaagaaaaaaaaagagagagagggagagagagaatttaaatgacatgattgaaaattatcactgttatggctgggtgcggtggctcacgcctgtaatcccagcactttgggaggctgaggcgggtggatcacgaggtcaggagatcgagaccatcctggctaacacggtgaaaccccgtctctac

SEQ ID NO: 66320 - DNA, 170 bp, Homo sapiens
gaaccaagtaagtaacatatgcaacacagtttaatagtatgattatatattgaggagtctgttcaaatgctttccaagtaagaggtagaaggctggaaacagcatcaccctcaagcttaccacaacaacaaaaaggcagcttatgtaaaaaatcccacattttctttaac

SEQ ID NO: 66321 - DNA, 432 bp, Homo sapiens
cttagtctgaactcccttttcaaagggaaaatgttttgcttcccagaatctttctcaacctaggtgtgcaggctagaaattctctaggaacttatgttttggctcagagaattcacatattttagaaaagcccattctatgctaggaaaactatttgaagtctcaaaattcgatgaagactgatactgtcagatgcttggaaataggcggaaaattttctgggtcctgagacacctaattctctaccctttagaaacctcatctagtcaataaaaatttaattgaaactgaaaaagtagaacatgaaattttgaataaatctaactcagggcctttcagatgttgactgggccaaaagcaaacattttctaatgaggaaaaccacatccttcatataacaaaggctgttttcaaaaaccagaggaccagcat

SEQ ID NO: 66322 - DNA, 859 bp, Homo sapiens
gtaccaactgaatttccatgtatttaaaattttttgtgtgtgaaaacatatagcaattggaaatctgtcaaggcaagtaaaaaacttttcccaatgttaatgaaatttgactcatgatatttatctacaagacataaaaatatagatggatcccagatactcaggaggctgaggcagcaggatcactggagcccaggagttcgtactggtggagaaaaacattactcacgtggtgacaaagtaccaggcagttgtaatgcacagccagagttaagattccctgctccttaaaaggggttcccagactcgcagcatatcggcgtcactggcagacccactgcgtcagcatgtgcagctgaaccatgtcccaggtgatcagtgattcatggtgactcgtcatccaagagcgtgttcctcttggctttccccacctccctgctttatgctctaatctctgcctgaaccatcatttctcatgactcctgcgcttcctccttcccatggggtaaagtccacacttttaatgtggcctccagccctttgcagtctgtccagtctccccttcagtctcttttaacatcacgtgaaccctccactccagtcaaaactccctgtagtttttggcctctcagatcctgtgtcattcctgctttttttccccctttgaaacctgagattaaaccctgctggctctgggaagccacttctaactgccatgacacagcacaatatccctttcctccggcacttactgtttcacaatttggtgagcatggcatgctgccttatactgtgatttaatcctttttaaaggttgaggtataaaataacataaactgtgtaaacagtcctgatctta

SEQ ID NO: 66323 - DNA, 342 bp, Homo sapiens
aatttggtgggtcttaaataactgacttagaaattatgtaatctcattaaaaatacctacactttttttttaatgaaaattagaaacatcctaaactgtatttagtaaagtcttgacaagttctttctgtgtgagttttaatggtgaactcttgctcaagaacaaagaacacgttcagacacgttagctaagggaaagtctaagctaaactcagagagaagaggtgttgcgggaagtcagggaccctgaacgaagggaccggctgaagccatggtagaagaacgtggattgtgaagattttatggacatttattggttccccaaattaatacttttgtaatt

SEQ ID NO: 66324 - DNA, 561 bp, Homo sapiens
tctcagaccattggattctcaaaactgaataatatacagagcttttttaaaagaaagtgttaaattatgtcttgttactcagatgtattcaagtataaaacttgattaccccttatactagtggttcttaaatgactgtaaaacctaaacagacatacattgaaatcaaactaattctaaaactcagaacttcagattgactctgtgaatgtagggtgatgcctcatgttactttgctgaaatcaaattgcccctcactcatcaccgttggggcaagttctttgtagcatgtatgtgctattgtatgctatgcagtgactccattctcttaccacttttctctaccgctatctgaactggtgtgaagccttcattcattaggatatgttctccttggtagtaatgtttggctttcacttatgaagtccgcctctattttttctcattagtcttcaacaattaaagttggttaattggcaccagcgcagtaggagacaaatgggagctctgaaatcctgccacttggtcataaggttaatattcggatgacccataacttta

SEQ ID NO: 66325 - DNA, 368 bp, Homo sapiens
tttaaacagctctcttggtgctacaggtagggctttttggcaagcagatgaaggtagcctaaataggtgattggtatgtatgtttgtcattgccctgaccttccttagttgttaagatagatcagtgagtaatgtagtcatcttttctagtgggaaatacacttttgtatgggaatgattgaactgataatgcaaggtgaaagtgttgttttgtgtcaaaatattcatttctcccataactgttgagtaaacgtagccattagtgtatgcatacaatttcccttaatcctcagagcattcaagcagcaggtagacactccctgctgagaaacatatttgagtgagatgagcatttttaaaaggcgcat

SEQ ID NO: 66326 - DNA, 1779 bp, Homo sapiens
cttttcccctgcctgcccttcgggcacctcaggaaggcaccttcctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaa

SEQ ID NO: 66327 - DNA, 449 bp, Homo sapiens
tttctcctctcctacccccccgggcccttctccctgcgtgagaaccgttcattaggtgcaatccaggttggagagtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66328 - DNA, 5523 bp, Homo sapiens
cttttcccctgcctgcccttcgggcacctcaggaaggcaccttcctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66329 - DNA, 5806 bp, Homo sapiens
cttttcccctgcctgcccttcgggcacctcaggaaggcaccttcctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagtaagaggaggcgtgggaagggggcgcggcctcagcagtctgggggcgtggcagagggggcggagactagccgaaaaggtggggcctggcttgccccaatagcagttgcaacgtgggttgggcctgagtgcccgaagctggacacagcgcggaaagagggcgaggcttgaacggccgaaagcgtggcccggatatcccgagaggaaaggggagggcggagggagcggcttgacccacaggaaggtcctgttcattaagctcctgggcaatgccccgcctttaggcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66330 - DNA, 6123 bp, Homo sapiens
cttttcccctgcctgcccttcgggcacctcaggaaggcaccttcctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttggtgagagaaggggcttcagacggtgggtgacgagctgagccagggtagacggtgccctgaccttggggttcctgagagtggggtaccccggacctcacaggcttctgggaaggaaagcccccggccactgggcaaggtggccccggaagggaggcccgagccgtgggatctttgaagaaggccgttttcatggccctgtgtgtgtgtcctgtgaagaagggtgacccagtcagcaagatatcctgactgggggggatgagggtgtcctggggaaggcacagtcctgggggttgtactatgcccacctttctccccagtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagtaagaggaggcgtgggaagggggcgcggcctcagcagtctgggggcgtggcagagggggcggagactagccgaaaaggtggggcctggcttgccccaatagcagttgcaacgtgggttgggcctgagtgcccgaagctggacacagcgcggaaagagggcgaggcttgaacggccgaaagcgtggcccggatatcccgagaggaaaggggagggcggagggagcggcttgacccacaggaaggtcctgttcattaagctcctgggcaatgccccgcctttaggcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66331 - DNA, 6355 bp, Homo sapiens
gggttcaagcgattcttgtgcctcagcctcctgagtagctgggattacaggcacgtgctaccatgcctggctaatttttgtatttttagtagagatggggtttcaccatgttggcaaggctggtcttgaactcctggtctcaggtgatccgtccaccttggcctcccaaagtgctgggattacaggcatgagccacagtgcccggcctgaggcccagcgttttgtaggtgtactggggagggcacccagcctgggagtgtcaagtctcctgtgactgtgccggagtatcttgagaggctgccacagggctggtgaaccaggaaagccctgagtgtctgaacctgattggagagaactgaataatcctgaccttttgatccacccaccccggcctcccaaagctctgggattacaggcgtgagccaccacgtctggccataaacaggaatttttaatattcatatcatagtcataaacgttcatcccttccatcctcatttttttttattgtgccatctttgagaacagaaagttttgtttagcgccttgcaaggtatctgacaacacaggaaatgataatcactgcgctaatgataatagcaaacgcttcgactggcccagctctaagccctctaagtttattaactcaaagctcacagttctcggcaggactaccctgtctcctccccagtccctggggtgagtgggtgggtttgcaggacccgctaagtgccatcctcccctcctctctcagggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttggtgagagaaggggcttcagacggtgggtgacgagctgagccagggtagacggtgccctgaccttggggttcctgagagtggggtaccccggacctcacaggcttctgggaaggaaagcccccggccactgggcaaggtggccccggaagggaggcccgagccgtgggatctttgaagaaggccgttttcatggccctgtgtgtgtgtcctgtgaagaagggtgacccagtcagcaagatatcctgactgggggggatgagggtgtcctggggaaggcacagtcctgggggttgtactatgcccacctttctccccagtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagtaagaggaggcgtgggaagggggcgcggcctcagcagtctgggggcgtggcagagggggcggagactagccgaaaaggtggggcctggcttgccccaatagcagttgcaacgtgggttgggcctgagtgcccgaagctggacacagcgcggaaagagggcgaggcttgaacggccgaaagcgtggcccggatatcccgagaggaaaggggagggcggagggagcggcttgacccacaggaaggtcctgttcattaagctcctgggcaatgccccgcctttaggcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtgtgagtcggtcaccctgacctttaatccctccacccctgccctggaaagattagacgctcctctgcaccactgtgcctcgggtgtgttgggtgtctgatcacacatggtggttccacagatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgagggtgagctaacacggggctgcgggtctggaccggtaagccggggggcgggggggttggagacagaagggacgcatattgacttagcgctttctctgcacagctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccacccttctaacgggccgggagaaggtcacgcagccgggtgagggggagggaaggcgcaacgggcctgggcccgtggagaatgatgggcccga

SEQ ID NO: 66332 - DNA, 3333 bp, Homo sapiens
  misc_feature (7)..(7): n is a, c, g, or t
cgagtanggatatcgtcgaccacgcctcgcctcaagatacgtgagtccggggcctcccgggggacgtgagggacaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66333 - DNA, 1871 bp, Homo sapiens
tagttctagatcgcgatctagaactataaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66334 - DNA, 4883 bp, Homo sapiens
gggttcaagcgattcttgtgcctcagcctcctgagtagctgggattacaggcacgtgctaccatgcctggctaatttttgtatttttagtagagatggggtttcaccatgttggcaaggctggtcttgaactcctggtctcaggtgatccgtccaccttggcctcccaaagtgctgggattacaggcatgagccacagtgcccggcctgaggcccagcgttttgtaggtgtactggggagggcacccagcctgggagtgtcaagtctcctgtgactgtgccggagtatcttgagaggctgccacagggctggtgaaccaggaaagccctgagtgtctgaacctgattggagagaactgaataatcctgaccttttgatccacccaccccggcctcccaaagctctgggattacaggcgtgagccaccacgtctggccataaacaggaatttttaatattcatatcatagtcataaacgttcatcccttccatcctcatttttttttattgtgccatctttgagaacagaaagttttgtttagcgccttgcaaggtatctgacaacacaggaaatgataatcactgcgctaatgataatagcaaacgcttcgactggcccagctctaagccctctaagtttattaactcaaagctcacagttctcggcaggactaccctgtctcctccccagtccctggggtgagtgggtgggtttgcaggacccgctaagtgccatcctcccctcctctctcagggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttggtgagagaaggggcttcagacggtgggtgacgagctgagccagggtagacggtgccctgaccttggggttcctgagagtggggtaccccggacctcacaggcttctgggaaggaaagcccccggccactgggcaaggtggccccggaagggaggcccgagccgtgggatctttgaagaaggccgttttcatggccctgtgtgtgtgtcctgtgaagaagggtgacccagtcagcaagatatcctgactgggggggatgagggtgtcctggggaaggcacagtcctgggggttgtactatgcccacctttctccccagtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagtaagaggaggcgtgggaagggggcgcggcctcagcagtctgggggcgtggcagagggggcggagactagccgaaaaggtggggcctggcttgccccaatagcagttgcaacgtgggttgggcctgagtgcccgaagctggacacagcgcggaaagagggcgaggcttgaacggccgaaagcgtggcccggatatcccgagaggaaaggggagggcggagggagcggcttgacccacaggaaggtcctgttcattaagctcctgggcaatgccccgcctttaggcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtgtgagtcggtcaccctgacctttaatccctccacccctgccctggaaagattagacgctcctctgcaccactgtgcctcgggtgtgttgggtgtctgatcacacatggtggttccacagatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgagggtgagctaacacggggctgcgggtctggaccggtaagccggggggcgggggggttggagacagaagggacgcatattgacttagcgctttctctgcacagctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgcgccagtgattggcccaataacccagccttgagtgtagcagagccctcatcca

SEQ ID NO: 66335 - DNA, 1710 bp, Homo sapiens
cttttcccctgcctgcccttcgggcacctcaggaaggcaccttcctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatgctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaa

SEQ ID NO: 66336 - DNA, 641 bp, Homo sapiens
catggtgccccaagctttcctgcgggaaattggggttttggggtattcctggggcctgatggtttctatgtctacacggatacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaa

SEQ ID NO: 66337 - DNA, 6699 bp, Homo sapiens
gggttcaagcgattcttgtgcctcagcctcctgagtagctgggattacaggcacgtgctaccatgcctggctaatttttgtatttttagtagagatggggtttcaccatgttggcaaggctggtcttgaactcctggtctcaggtgatccgtccaccttggcctcccaaagtgctgggattacaggcatgagccacagtgcccggcctgaggcccagcgttttgtaggtgtactggggagggcacccagcctgggagtgtcaagtctcctgtgactgtgccggagtatcttgagaggctgccacagggctggtgaaccaggaaagccctgagtgtctgaacctgattggagagaactgaataatcctgaccttttgatccacccaccccggcctcccaaagctctgggattacaggcgtgagccaccacgtctggccataaacaggaatttttaatattcatatcatagtcataaacgttcatcccttccatcctcatttttttttattgtgccatctttgagaacagaaagttttgtttagcgccttgcaaggtatctgacaacacaggaaatgataatcactgcgctaatgataatagcaaacgcttcgactggcccagctctaagccctctaagtttattaactcaaagctcacagttctcggcaggactaccctgtctcctccccagtccctggggtgagtgggtgggtttgcaggacccgctaagtgccatcctcccctcctctctcagggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttggtgagagaaggggcttcagacggtgggtgacgagctgagccagggtagacggtgccctgaccttggggttcctgagagtggggtaccccggacctcacaggcttctgggaaggaaagcccccggccactgggcaaggtggccccggaagggaggcccgagccgtgggatctttgaagaaggccgttttcatggccctgtgtgtgtgtcctgtgaagaagggtgacccagtcagcaagatatcctgactgggggggatgagggtgtcctggggaaggcacagtcctgggggttgtactatgcccacctttctccccagtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagtaagaggaggcgtgggaagggggcgcggcctcagcagtctgggggcgtggcagagggggcggagactagccgaaaaggtggggcctggcttgccccaatagcagttgcaacgtgggttgggcctgagtgcccgaagctggacacagcgcggaaagagggcgaggcttgaacggccgaaagcgtggcccggatatcccgagaggaaaggggagggcggagggagcggcttgacccacaggaaggtcctgttcattaagctcctgggcaatgccccgcctttaggcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtgtgagtcggtcaccctgacctttaatccctccacccctgccctggaaagattagacgctcctctgcaccactgtgcctcgggtgtgttgggtgtctgatcacacatggtggttccacagatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgagggtgagctaacacggggctgcgggtctggaccggtaagccggggggcgggggggttggagacagaagggacgcatattgacttagcgctttctctgcacagctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66338 - DNA, 5925 bp, Homo sapiens
cttttcccctgcctgcccttcgggcacctcaggaaggcaccttcctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagtaagaggaggcgtgggaagggggcgcggcctcagcagtctgggggcgtggcagagggggcggagactagccgaaaaggtggggcctggcttgccccaatagcagttgcaacgtgggttgggcctgagtgcccgaagctggacacagcgcggaaagagggcgaggcttgaacggccgaaagcgtggcccggatatcccgagaggaaaggggagggcggagggagcggcttgacccacaggaaggtcctgttcattaagctcctgggcaatgccccgcctttaggcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtgtgagtcggtcaccctgacctttaatccctccacccctgccctggaaagattagacgctcctctgcaccactgtgcctcgggtgtgttgggtgtctgatcacacatggtggttccacagatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66339 - DNA, 5472 bp, Homo sapiens
  misc_feature (1)..(1): n is a, c, g, or t
nccgttacggcccggaatttttgggcattgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66340 - DNA, 6763 bp, Homo sapiens
gggttcaagcgattcttgtgcctcagcctcctgagtagctgggattacaggcacgtgctaccatgcctggctaatttttgtatttttagtagagatggggtttcaccatgttggcaaggctggtcttgaactcctggtctcaggtgatccgtccaccttggcctcccaaagtgctgggattacaggcatgagccacagtgcccggcctgaggcccagcgttttgtaggtgtactggggagggcacccagcctgggagtgtcaagtctcctgtgactgtgccggagtatcttgagaggctgccacagggctggtgaaccaggaaagccctgagtgtctgaacctgattggagagaactgaataatcctgaccttttgatccacccaccccggcctcccaaagctctgggattacaggcgtgagccaccacgtctggccataaacaggaatttttaatattcatatcatagtcataaacgttcatcccttccatcctcatttttttttattgtgccatctttgagaacagaaagttttgtttagcgccttgcaaggtatctgacaacacaggaaatgataatcactgcgctaatgataatagcaaacgcttcgactggcccagctctaagccctctaagtttattaactcaaagctcacagttctcggcaggactaccctgtctcctccccagtccctggggtgagtgggtgggtttgcaggacccgctaagtgccatcctcccctcctctctcagggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttggtgagagaaggggcttcagacggtgggtgacgagctgagccagggtagacggtgccctgaccttggggttcctgagagtggggtaccccggacctcacaggcttctgggaaggaaagcccccggccactgggcaaggtggccccggaagggaggcccgagccgtgggatctttgaagaaggccgttttcatggccctgtgtgtgtgtcctgtgaagaagggtgacccagtcagcaagatatcctgactgggggggatgagggtgtcctggggaaggcacagtcctgggggttgtactatgcccacctttctccccagtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagtaagaggaggcgtgggaagggggcgcggcctcagcagtctgggggcgtggcagagggggcggagactagccgaaaaggtggggcctggcttgccccaatagcagttgcaacgtgggttgggcctgagtgcccgaagctggacacagcgcggaaagagggcgaggcttgaacggccgaaagcgtggcccggatatcccgagaggaaaggggagggcggagggagcggcttgacccacaggaaggtcctgttcattaagctcctgggcaatgccccgcctttaggcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtgtgagtcggtcaccctgacctttaatccctccacccctgccctggaaagattagacgctcctctgcaccactgtgcctcgggtgtgttgggtgtctgatcacacatggtggttccacagatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgagggtgagctaacacggggctgcgggtctggaccggtaagccggggggcgggggggttggagacagaagggacgcatattgacttagcgctttctctgcacagctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagccttcgtgaccctgctgaatggggagcaggccgaggccgcaatcaatgctttccaccagagccgcctgcgggagcgtgaactgtcggtgcagctgcagcccacggatgccctgctgtgtgtggccaacctgccccccagcctcacacagcagcagttcgaggagctggtgcggcccttcggcagcctggagcgctgcttcctggtctacagtgagcgcactggccaatccaagggctatggctttgctgagtacatgaagaaggactcggctgcccgtgccaagtcggacctgctgggcaagccgctgggaccacgcaccctctacgtgcactggacggatgccgggcaactgacgcctgcccttctccactcccgctgcctctgtgtggaccgcctgccacctggcttcaacgatgtggacgctctgtgccgggcgctgtcagctgtccacagccccaccttctgccagctggcgtgcggccaggatgggcagctgaagggcttcgcggtgctggagtatgagacggctgagatggcggaggaggcacagcagcaggcggacggcctgtccctggggggcagccacctgcgagtctccttctgcgcccctgggccccccggccgcagtatgctggccgctctcatcgctgcccaggccacggccctcaatcgggggaagggactcctccccgagcccaacatcctgcagctgctcaacaacctgggcccatccgcgtccctccagctgctgctcaaccccctgctccatggcagtgcgggggggaagcagggcctcctgggtgcccccccagccatgccgctgctcaatgggccagccctgtccacggcgctgttgcagctcgccctgcagacccagggccagaagaagcccggcatcctgggagactcacccctgggcgccctccagcctggggcccagccagccaaccccctcctcggggagctgcctgcaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggttgtctgagggagaagtacttgtgaagagctcttcatatattgttcttctagtggcttttgtcatacaccctcagcgctcgttgataaatcgcccttggcattggctctgaaagacgatgatggggtgtccctcgggtctttgttcttcactctaccacttattcctatactacggacttagttgatacccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66341 - DNA, 4522 bp, Homo sapiens
gggttcaagcgattcttgtgcctcagcctcctgagtagctgggattacaggcacgtgctaccatgcctggctaatttttgtatttttagtagagatggggtttcaccatgttggcaaggctggtcttgaactcctggtctcaggtgatccgtccaccttggcctcccaaagtgctgggattacaggcatgagccacagtgcccggcctgaggcccagcgttttgtaggtgtactggggagggcacccagcctgggagtgtcaagtctcctgtgactgtgccggagtatcttgagaggctgccacagggctggtgaaccaggaaagccctgagtgtctgaacctgattggagagaactgaataatcctgaccttttgatccacccaccccggcctcccaaagctctgggattacaggcgtgagccaccacgtctggccataaacaggaatttttaatattcatatcatagtcataaacgttcatcccttccatcctcatttttttttattgtgccatctttgagaacagaaagttttgtttagcgccttgcaaggtatctgacaacacaggaaatgataatcactgcgctaatgataatagcaaacgcttcgactggcccagctctaagccctctaagtttattaactcaaagctcacagttctcggcaggactaccctgtctcctccccagtccctggggtgagtgggtgggtttgcaggacccgctaagtgccatcctcccctcctctctcagggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttggtgagagaaggggcttcagacggtgggtgacgagctgagccagggtagacggtgccctgaccttggggttcctgagagtggggtaccccggacctcacaggcttctgggaaggaaagcccccggccactgggcaaggtggccccggaagggaggcccgagccgtgggatctttgaagaaggccgttttcatggccctgtgtgtgtgtcctgtgaagaagggtgacccagtcagcaagatatcctgactgggggggatgagggtgtcctggggaaggcacagtcctgggggttgtactatgcccacctttctccccagtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagtaagaggaggcgtgggaagggggcgcggcctcagcagtctgggggcgtggcagagggggcggagactagccgaaaaggtggggcctggcttgccccaatagcagttgcaacgtgggttgggcctgagtgcccgaagctggacacagcgcggaaagagggcgaggcttgaacggccgaaagcgtggcccggatatcccgagaggaaaggggagggcggagggagcggcttgacccacaggaaggtcctgttcattaagctcctgggcaatgccccgcctttaggcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtgtgagtcggtcaccctgacctttaatccctccacccctgccctggaaagattagacgctcctctgcaccactgtgcctcgggtgtgttgggtgtctgatcacacatggtggttccacagatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgagggtgagctaacacggggctgcgggtctggaccggtaagccggggggcgggggggttggagacagaagggacgcatattgacttagcgctttctctgcacagctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaatctgtggtttgattccacccgcgctgcaagtctctcccacccaggtgcacatccactgagtagcgtcgctgcgacggaagggggcggggcctgtggcgcgcagacgcagcttgaactcttgagaggtgggctggggcttagccaacggggcaaggggggcgggaaggaggtggggtttctcccagccaatcgacgggcgcgccctcgttgccgctctatgccgctccgccccggctcgctggtcccagaaggcgccgggtttcccaagatggcggcggacgtgtccgttactcaccggcccccgctgagccctaagtctggggccgaagtcgaagccggcgatgccgcggagcgccgggcgccggaagaagagctgccgcctctagatccagaagagatccggaaacgcctggaacacaccgagcgccagttccgtaaccgccgcaagatactgatccggggcctcccgggggacgtgaccaaccaggaagtacatgacctgctcagtgactatgagctcaaatactgttttgtggacaaatacaaagggacagcccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66342 - DNA, 1847 bp, Homo sapiens
gaattcccgggtcaaaccacgcgtccgtagagcagcagcaaagccttccagctcaagtcccgcctgctcagccccctcagcagcgcccgcctgccccccgaaccaggactgtctgacagctacagcttcgactacccctcggacatgggacctcggcggctcttctcccacccacgggaaccagcccttgggcctcacggacccagccgacacaagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggcaatcggctcttccccgctggggtccggagaagggctcctgggcctcagccccgggcctaatggtcacagccacctgctgaagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagccacagatgccaagctctgggagcttgactatggaccaaacagctctggcctagggattgggccaccctacccaggatctccaccctggggacagtagaaggggaaagccttcatcttggcgaaccggccccaccaccccctcctacccgggcctccgtgcagagatgggctttctctgccagtcccctgctgtctgtctgtgggagtcggacattgtgcccatctcccggagcctctgctgtcactcgcttgttgaagatgaattcttgaattctgcctgcccacccccggccagatccctggagctggcctccttccagcccagtgccagaaaccagcactccatgaagataaactctgggcccgcccaccagcaggacctgtcgacctgaggtgaccctgggccttgcccccagccaactgggccaccagcttccctcccttgactctgggggtccacatccactccaaggggactattcccccgaccccaccccagtctccccacacggacctttgctgaattaaagtttgtaagtaaatggttttaaagaaaaaacaaaaagttgg

SEQ ID NO: 66343 - DNA, 1956 bp, Homo sapiens
  misc_feature (1907)..(1907): n is a, c, g, or t
cttttcccctgcctgcccttcgggcacctcaggaaggcaccttcctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacaggctcccggagcgtgtggagctggcacccctgcctccttggcagccggtgggccagaacttcaccctgcgctgccaagtggaggatgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaaaaaaaaaaaaaacaccacaacaacccccggctcttgggggggaaaaggaaaagggccggccactgttccccgccctttgaaaaggagaccggccaaagggcgtaataacaccgcgctccgcccaagcnagccaacgcaacaaaacggaaacccaccccagccacacccgcccgccac

SEQ ID NO: 66344 - DNA, 388 bp, Homo sapiens
catttcatcacttagagtataatgttattaatttgtagtaatttggaaaatttcaattagtaaaaaagtctaaattagagtattttgaaataaagtattatttttgaagttcagagagtggctcagatagctatgtgcttctatttgtagaaccttaaaatgttgttaatgaacaactttttagtcagtttttgttcgtatacattatacatatatttgagtctacaaaatatttgatataataaaactcctatatttataagtataccttctaaaatcttgttatagtttattaaacataaaaaatgctaataatttatgttaaatgttaaagtcatattacctattaaatttgactttgaatgctgtctagggacagcattaacta

SEQ ID NO: 66345 - DNA, 461 bp, Homo sapiens
  misc_feature (51)..(51): n is a, c, g, or t
  misc_feature (78)..(78): n is a, c, g, or t
  misc_feature (147)..(147): n is a, c, g, or t
agctgggaacagacactgccaccacacctagctaaggtatttgtagtgacngggtcacctgtttgccaggctggtctnaaactcctgacctcagcatccttctgcccttcccttctgtcgtcttctcgcagcccggtttaggccccncgaattcgcggccgcgtcgactcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccaca

SEQ ID NO: 66346 - DNA, 507 bp, Homo sapiens
gaggggtcgcgcggcggcggcgtcagcggcggcgcccggggggtgggagccgaggcgccgagcaagatggcggcgcgagtgctgcgcgcccgcggagcggcctgggccggcggcctcctgcagcgggcggccccctgcagcctcctgcccaggctccggtgagcagcgccgcccttgcccggtaggtgccgggaagggtccgccgcgaggcggagggcgcgggtttcccggcgccggtctccgccccggccctgtccccagcgcgggtggctgcccggcctcggggcagtggggccggagctggggtggggccggagctggggcggggtcggggcgtcctcgggctcaaggtcacggaggggacgggccgctctgcggctccaccctcgcccgggaaggcccccgaggcttggcccggaggccacatcctccccgcggcgctggcccggcctgcagggccctgaccggcgcgacccgtggccagggacagggacagcgcgcgcctga

SEQ ID NO: 66347 - DNA, 1966 bp, Homo sapiens
gaggggtcgcgcggcggcggcgtcagcggcggcgcccggggggtgggagccgaggcgccgagcaagatggcggcgcgagtgctgcgcgcccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtca

SEQ ID NO: 66348 - DNA, 2004 bp, Homo sapiens
taggaggggggctggggcccccgagccgggcgacggctgcagcggcgcgaggggggacgccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccaca

SEQ ID NO: 66349 - DNA, 1890 bp, Homo sapiens
  misc_feature (33)..(33): n is a, c, g, or t
agagaaaaaatgacttagtcaggccgcggttanttcggcgagggagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccaca

SEQ ID NO: 66350 - DNA, 1743 bp, Homo sapiens
  misc_feature (7)..(7): n is a, c, g, or t
  misc_feature (10)..(11): n is a, c, g, or t
  misc_feature (15)..(15): n is a, c, g, or t
ttgctgnggnnactntagaggatcccctgccgagatgcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccaca

SEQ ID NO: 66351 - DNA, 1586 bp, Homo sapiens
tcggcacgaggtgtcaagaggtgttgccaaagattcacgaagataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccaca

SEQ ID NO: 66352 - DNA, 1278 bp, Homo sapiens
ttcaagcagcacatctgtgaacattctcggcaatctgtctgttagtgtcatttaccataatgtgtttagaaagtaacaagtgcagtaaccctgatcttgttttcagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccaca

SEQ ID NO: 66353 - DNA, 1205 bp, Homo sapiens
caggtggtcgggatgaattggggtatagaacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccaca

SEQ ID NO: 66354 - DNA, 1039 bp, Homo sapiens
aagactggtatcaacgcagagtgcccattacggccgctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccaca

SEQ ID NO: 66355 - DNA, 534 bp, Homo sapiens
agctctggatgacctaaaactgtctaattcaggaactgtttgtcacacacatagagtttatcttgggctgactttgctttccaccctcccttcactagcaggtgtttgtcaatagggagaaatttaaaagccacacatcattaagaaagaaattcttttgtatagattcccagacaaatataaataggttttgaattatctgctcttttgtagtctgcatgctacttctattgatgtgccatcaaacactgttagaagaatctaaaaatatagcaaattaaatttgtttgcattgccacctaaataattaggatgaccaagtaatttgtcatctaaacctggacacttttgagaatgaaaaggaatgctgttaatgattatgcaagctcaacagatgtaaactgggactgtctcaggccaactgggacctgttgattaccctattatagtattctgtaggaacatcaatgttactgaaatgggcttatatgtaagtatcagaagatttcatgagcacatttttttcactcaaag

SEQ ID NO: 66356 - DNA, 203 bp, Homo sapiens
ttcacaatgttaaaccggaatgcctagaagcatacaacaaaatttggtgtgtataccaaactatcctttacttggggaaaaataatgactttatttgttagttaattccactaacacttgatagcatagagagagatctttcatccctctcttttgaagctgaacattcagaggctcttaaactgagcttcatgtgggattgc

SEQ ID NO: 66357 - DNA, 2034 bp, Homo sapiens
gaggggtcgcgcggcggcggcgtcagcggcggcgcccggggggtgggagccgaggcgccgagcaagatggcggcgcgagtgctgcgcgcccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccaca

SEQ ID NO: 66358 - DNA, 2068 bp, Homo sapiens
gaggggtcgcgcggcggcggcgtcagcggcggcgcccggggggtgggagccgaggcgccgagcaagatggcggcgcgagtgctgcgcgcccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccacaaaaaaaaaaaaaagaatactcgagcctagttctc

SEQ ID NO: 66359 - DNA, 1915 bp, Homo sapiens
gtgcgtctgccgaggacgttggtgaccctggtctctgaggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccaca

SEQ ID NO: 66360 - DNA, 1987 bp, Homo sapiens
gaggggtcgcgcggcggcggcgtcagcggcggcgcccggggggtgggagccgaggcgccgagcaagatggcggcgcgagtgctgcgcgcccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgtccacctctggaggtatgaaggaggctatccagccctcacagaagtcatgaataaactcagagaaaataaggaagaatcagctcctgttggagttcagtttctggaatgagcctgtgccaagatccggacctaatatatatgaactcaggtcttaccaactccgaccaggaaccatgattgaatggggcaattactgggctcgtgcaatccgcttcagacaggatggtaacgaagccgtcggaggattcttctctcagattgggcagctgtacatggtgcaccatctttgggcttacagggatcttcagaccagggaagacatacggaatgcagcatggcacaaacatggctgggaggaattggtatattacacagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacacttagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccaca

SEQ ID NO: 66361 - DNA, 473 bp, Homo sapiens
gaggggtcgcgcggcggcggcgtcagcggcggcgcccggggggtgggagccgaggcgccgagcaagatggcggcgcgagtgctgcgcgcccgcggagcggcctgggccggcggcctcctgcagcgggcggccccctgcagcctcctgcccaggctccggacatggacatcttccagcaacagatctcgagaagacagctggctaaaatccttatttgtccggaaagttgatccaagaaaagatgcccactccaatctcctagccaaaaaggaaacaagcaatctatacaaattacagtttcacaatgttaaaccggaatgcctagaagcatacaacaaaatttgtcaagaggtgttgccaaagattcacgaagataaacactacccttgtactttggtggggacttggaacacgtggtatggcgagcaggaccaagctgttcacctctggatatgctcgggcgccgaatcctc

SEQ ID NO: 66362 - DNA, 367 bp, Homo sapiens
caataagatagatagatgatagatagatagatagatagatagatagctatagatggatagatagatagacagatatgtactatctggcccttagaaaaagttcgttgatccctacatactttagagtttatagtatatatctttaacttatcatggtctaccatcaagtgatattataacacttcacatatagtagaagaaccttaaaacagtatatttttatttttcccttcctggcctttatgttattgttgttaaacattttacttgtacatatggtataaaccctacaaaacagttgttatttttgctttacataaatttttttttttttgagatggagccattgcactccagcctgggcgca

SEQ ID NO: 66363 - DNA, 361 bp, Homo sapiens
ttttaagaaagagtggtttggctgggcatggtggctcacacctgtaatcccagcactttgggaggccaaggaaggtggatcacttttacccaggagtttgagaccagcctgggcaacatggtgaaaccccatctctacaaacaaagtataaaaattagccagccatggtggtgcatgcctgcagtcccagctacttgggaggctgaggcgggaggattgcttgatcctcgaaggtcaaggctgcagtgactggagactgtgccattgtactccagcttgggtgacagagaaaaaaacaaaagtaagaaaagaaatagtgatttgtctcccaaatttgataaaaataaataaaaacaaaata

SEQ ID NO: 66364 - DNA, 404 bp, Homo sapiens
ggattaaatagaattggcaaatgaagtcagaaagaggtttaatgatagaatactttgaagaaggatgttgggtctttgggatttaacatttatgctgggaggttatattttccattatttaaaaaattagaatcattttcccagagcatacttttgccaaaagtttttgcagaaaacttggggacatgggcttataccagactgaatggttgccgtagggtatgggtagttcagagattttaactgaagcacctctcatattctagacactattctgggggcttgggatacatgagagaacaaaaccaagatcctgaggtgaatgggttgagacagctaattagaaaatgaacataactgtacattatctagtatgttgggaggtgataccagaaaaagaaaag

SEQ ID NO: 66365 - DNA, 519 bp, Homo sapiens
taaacatattagaatagatttgttgaagtaacattgttggtggggggaatgttcatataaaattgtgatagatattaccaatttgccattcataaggtatctatgagttcacccttccacctgtactgtatcagacagcttgtctctctttagtgtggctgatatgattcttaacaatctttgaaagacaaaaaaaggtatctcatggttttgaacacctattatttttactgggtttgagcaacttttcgcatatttaaaaataattattttctttatgtgaactggcatttcatgtattttgcttttatttctactgatttgctaacctttttattgattggtaggagatctgtataaggaaattcatccatttggggtcacattaatgtcaaaaaatttatccaagtttacacctatttgtttgattttattgtgctaaaattgctaaaatattttatatttgggtgatgaaatttatccacctttgctttaagatttctaggttttgatatttgc

SEQ ID NO: 66366 - DNA, 737 bp, Homo sapiens
agcggccgcggcatgaaaggcggcgaggagaggcagcactgctgctcttgacttctgagcagggcttagagagcctgccccggcttaagccgagctgctggtgctgaccctgagcgccgagtccgcgagctctgagtccggagcctcccagccgtggagccgtgggatgaggggggcgttgggggacagggcaaagtcgatcttggttgtacagccgcccgatcctagcgcggagctgcgagcctgaccggccgcgtctggcatggtcagagaaagaattttcttttcccaactccggcttttggttttgtgtgtccaccttgcgcaactccggagccagccgaccccacatggattctcaacaggtggccggcacatcttctgagcctcgctctctcatctgaaagtggagtgtaagtccaagaagattcatttagacaaagaaggtggaaaaaaaggactttctgggccagcaagtcggatgaccaccctccaaggggcagaggagggcccattttgtgaagaagaaatcaactacccggaaaacgccacaggaggacatgtttctgcagatgtagttgccctagaaacagaagagtatgggggtgtgaatgtcttctcttttgggggcaaacactatgtccttttctttttctagatacagttaattcctggaaattttagcgagtttgttcttgtggatattttgaacaataaagagtgaaaatcactttgga

SEQ ID NO: 66367 - DNA, 974 bp, Homo sapiens
agcggccgcggcatgaaaggcggcgaggagaggcagcactgctgctcttgacttctgagcagggcttagagagcctgccccggcttaagccgagctgctggtgctgaccctgagcgccgagtccgcgagctctgagtccggagcctcccagccgtggagccgtgggatgaggggggcgttgggggacagggcaaagtcgatcttggttgtacagccgcccgatcctagcgcggagctgcgagcctgaccggccgcgtctggcatggtcagagaaagaattttcttttcccaactccggcttttggttttgtgtgtccaccttgcgcaactccggagccagccgaccccacatggattctcaacaggtggccggtgtcaacgcgctagagaggccgtctcacctccaaaggtatcttcactcccggagggcccgggctcccagccgcagtcccacactgggcccgcgcgccggatacgaggtgctccgacggcaaaaatcccatacatttttaactacagtgattactaaattaatagcaggcactaagacagatgtcaaaacgtcttgaaaatgtttatctgtgaataattgagaaggtggtgggacgcattatctgattgtgtaatgaaatatgtatgaggaacagctgtttgcaacagtcccctcccgccgcctcctcagccaaggcccttctctaggaagcaggagtcgcggcgaagttggtcgcctacttccgtccacttgggagccctcgcggcccctccccggctgctggcagaatggtggctccagcgcgccccagagtagtccggtttcccgacggacaacagcatggagtcctcctcagcctcgctctgtgggctccgtgcctgagtgaggctccaccgccggccgcgctgtccctcgcgccttcggggccggccgcgggctcggcctgcggggaccgaggggagcactggcccgggcggccgcg

SEQ ID NO: 66368 - DNA, 911 bp, Homo sapiens
aggacatggaactaacctgaaggagctcatgatggccagagccgggctgctcaagcaacaaaataaataaactgtagcagcagcttgttacctacagaaaaaaataaatatccatgctaatataagtaagtaactgaatgaattaacaagtgggaaaaataagggagacggggcagctctctttacagaattccaattaataaatgtaaacagaaagacagaaatagaaagtcagcatcagacgccacagcagcctccactggcagcgtccttgcgaatgcccacgcaggggccaaaggcctgataagaaatggtatcagcagcctccaagtgtctccttgagatacctactaattacacagagaaaaagagtaactcgacaatggagtaaccagccaaccccaccttaaccaagcttcaaagtcagcagcagcagcagcaacagccaggcgacaccacctgcctcccaatccagtgctctgaggacacgccagccggcccgcggcattctaactgagattctacagcctggacgtcatcacgaggagacaccagacaaacgcaaactaaggaaacgtccaccagacaaggaccagagctctccagcacgtcaaggccatcaaagaccaggaaagactgagcagctaccaccaagcagaggagaccaaggagccgaggagccgcgagggtcccggggcaggaaaggacgtcgaggacactggtaagaatcgaataaggagaaaatatttgcaaaagacacatctgataatggactattatccaaaatataccaagaactcctgaaactcaacaatatcaacaataagctgctccgcatcctccgtcaccagggagatgcaaattaaaacaagatgcacacacctactagagcggccaaaacccagaacacg

SEQ ID NO: 66369 - DNA, 5822 bp, Homo sapiens
  misc_feature (4285)..(4285): n is a, c, g, or t
gagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatgacgccacacgcggttctgctgttaaaaggttttctatctcatttgctcgacacccaaccaatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtntgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaaaaaaat

SEQ ID NO: 66370 - DNA, 198 bp, Homo sapiens
gcggccgcctactactactactactgctcgagttcaagcttctaacgatgtacggggacatgtcttgtaaacagttgaatgtatgtaagttttctgtttgtgaaaatgtagttaatgtactcactgtggaggtcataaggaagctactttttttttaaagtggaacctaattaaaatatttccagaatcaaaaaaaat

SEQ ID NO: 66371 - DNA, 5465 bp, Homo sapiens
  misc_feature (3928)..(3928): n is a, c, g, or t
gagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgttgtatctgaaaatgctaattacctgagaacaccaagaactcttgtggaacagaagcagaatcctactgtaggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtntgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaaaaaaat

SEQ ID NO: 66372 - DNA, 5648 bp, Homo sapiens
  misc_feature (4111)..(4111): n is a, c, g, or t
gagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatgacgccacacgcggttctgctgttaaaaggttttctatctcatttgctcgacacccaaccaatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtntgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaaaaaaat

SEQ ID NO: 66373 - DNA, 5693 bp, Homo sapiens
  misc_feature (4156)..(4156): n is a, c, g, or t
gagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaataccaatgattctcagaatgaagatggaggaatggtgaaggagatggaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatgacgccacacgcggttctgctgttaaaaggttttctatctcatttgctcgacacccaaccaatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtntgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaaaaaaat

SEQ ID NO: 66374 - DNA, 1939 bp, Homo sapiens
  misc_feature (402)..(402): n is a, c, g, or t
attttcttctgttattatgaatattcgtagggtcactaaattataagaaactttctatgatgttaagagataattggcaggaaattattaaattaacatgtttgtttattttttttcagcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtntgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaaaaaaat

SEQ ID NO: 66375 - DNA, 479 bp, Homo sapiens
gagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtgagggcccaaaaccggaggagaaccggagatgcggaacctgatcatgccagggttgaggcggctgctgggcttctgctttgtctcctgtgctctgcagaccctaaacacatgctccaccgaggggcttgtgctggagagaatgacagcctgggcgtggagtgacagtacagctttgagggtcctttcgcgccttgatttctcctcctgctcccccatggcttccctttttcatttcttgggttcgagacgcc

SEQ ID NO: 66376 - DNA, 238 bp, Homo sapiens
ttaatgaaatgaatcttttatgggaggtggcatcaattcaagttaataaagtatagatgcttatcttgagataatacagaatatgttaataatatgtgttcttaggatttccactggacaaagcggttgcctatgcaaaactcaggaatccatttgtaatcaatgacttgaatatgcagtatctcatacaagataggtgagtggtgaagttggctgaattaagggaaggaaaaataac

SEQ ID NO: 66377 - DNA, 501 bp, Homo sapiens
actttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctgtaagttgtttgtttttcctttggcgagagaagaccaatacagtataggctttttactaatcactgttagtctttttttgttggaaaatttttgaactgaaaaagtatattttgtttcatgactgatgttgttgaatctatgatgaatcaataaatacagttatgggtcaaacc

SEQ ID NO: 66378 - DNA, 258 bp, Homo sapiens
cctacagacatgacctcaaaatatatgcctctgatgaaggacgagtccagatgactgcagctgcttttgcaaaggtataaataatttttttttagaattattagagtttttaatctaatattgtatcttaaaacatttttggctgggcgcagtggcttacacctgtaatcctagcactttgggaggctgaggtggtcagatcactagagcccaggagtttgagacaagcctgggcaacatgacgaaacctgtctctgc

SEQ ID NO: 66379 - DNA, 523 bp, Homo sapiens
ggttgccttatatgtggtaagagccatgttaattgcatgctgcatgaattcccaatgtgaatggaagaacacccgttgtgtatgtattttctctaactcccatcagggtctcactgtgcgggcctgtttagcacctcggtgctcgggggttcttcaagcgcacctaacctacaggattatgctcgtactcatcgtaaaaagctgacctcttctggctgcatagatggtatgtgcacacatgcacacacagattcatacctacacccatgcacacacccatgagcagtatttctcaaaggcaaatctaaggccactgactgattcgagtgaaatcctgtcatcttttgcctaaatgactatcagtgctctctgttatctacaacttggatccatgtttcatcagacagttaattgtagttagatttacagtacttgtacaataagtttgttgaaatggaaaacttagaagagtattatgtgtattcttcttttagataattgattatattataaagagcaagcg

SEQ ID NO: 66380 - DNA, 951 bp, Homo sapiens
gagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggtattaaggggagtgggggagaaactcctttatcctctctgtttataaaactaatacatattaattgtagactatgagataaaacagaaaaataaacattaactcactttcatggacaggtaaaaaaaaaac

SEQ ID NO: 66381 - DNA, 5759 bp, Homo sapiens
  misc_feature (4222)..(4222): n is a, c, g, or t
gagggcggggaagaggcgtgacggagattcctgaggtgtagtagcctgaggttcccttatgtggccctatagctgttactgaaggaagtagcctacgtccacgcctacaactgaagtctcttgacaaacacctcacccctgcctccgggatgaaagggggtaacctagacctgaatgggcttgaccatctcacaactgctcgcgtgacgaccgcattcgtggcaggtaagaagattgctgtatcaactcaagaaagcagtaacttcactgtctttgtattttgaattgcaacaacaactttgatatcaacaatgaagcaatgatatctaagaacaaaagagtatttgccaacagtcatcataatatcaagtgattgtataagcagaaacaagctgtcacagacctgtgcgtcagctaatatatggagaatgctttcttctgatactatttacttagaggcagttttaatataaatcatttcaattatatctacatcaaataaaataaaaatgagtgaagcccccagattcttcgttggaccagaagatacagaaataaatcctggaaattatcgacatttcttccaccatgcagatgaagacgatgaggaggaagatgattctccaccagaaaggcagattgtggttggaatatgttccatggcaaagaaatccaaatccaaaccaatgaaggaaattcttgaacggatctccttatttaaatatatcacagtagtagtatttgaagaggaggttattttgaatgaaccagtggaaaactggcctttatgtgattgtcttatttctttccattctaaaggatttccactggacaaagcggttgcctatgcaaaactcaggaatccatttgtaatcaatgacttgaatatgcagtatctcatacaagataggagagaagtatatagtattcttcaagctgaaggtattttacttcctcgttatgctattttgaaccgtgacccaaataatcccaaagaatgtaatctgattgaaggggaagatcatgtagaagtaaatggggaagtttttcaaaagccatttgtagaaaagccagtcagtgcagaagatcacaatgtttacatttattacccaacttctgctggtggtggaagtcaaagactctttagaaagattggcagtagaagtagtgtttattctccagaaagcaatgtacgaaaaacaggctcatatatatatgaagagtttatgcccacagatggtactgatgttaaggtttatacagtgggtccagattatgcccatgctgaagctcgaaaatctccagcacttgatggcaaggtggaacgagacagtgaaggaaaagaagtaagataccctgttattctcaatgcacgagagaaattaattgcttggaaagtctgccttgcttttaagcaaacagtttgtggctttgatttgttacgggccaatggacagtcctatgtctgtgatgtcaatggcttcagttttgtgaaaaattccatgaagtattatgatgactgtgcaaaaatacttggaaatattgtaatgcgagaacttgctccacaatttcatattccatggtcaatacccttagaagctgaagatatcccaattgtaccaactacatctggaactatgatggaacttagatgtgtcatagctgttatacgtcatggggatcgaacaccaaaacaaaaaatgaaaatggaagtgagacatcagaaattttttgatctttttgaaaagtgtgatggatataaatcagggaaattaaaactcaaaaaaccaaaacagttacaggaagtgctagatattgcacgacagcttcttatggagctagggcaaaataatgattctgaaattgaagaaaacaagccaaaacttgaacaacttaagactgtattagagatgtatggtcatttttctggaataaatcgtaaggttcagttgacctatctccctcatggttgtcctaaaacatctagtgaagaggaggacagccgaagagaagaaccatctttacttttggttctaaaatggggaggtgaattaactcctgcaggcagggtccaggctgaagaacttggaagagccttcaggtgtatgtatcctggaggtcaaggagattatgcaggatttcctggttgtggtttacttagattacatagcacctacagacatgacctcaaaatatatgcctctgatgaaggacgagtccagatgactgcagctgcttttgcaaaggggcttttagctttggaaggagagcttacacccattcttgttcaaatggtgaaaagtgcaaatatgaacggtcttttggatagtgatagtgactctctgagcagttgtcagcaacgtgtgaaggcaaggcttcatgaaatacttcagaaagacagagattttactgctgaagattatgaaaagcttactccatctggaagcatttctcttatcaaatcaatgcatttaattaaaaaccctgtgaagacctgtgataaagtttattccttaattcagagtttgacttctcaaatcagacatcgaatggaagatcctaaatcatcagatattcagctttaccatagtgaaacattggagcttatgctacgtagatggtccaagttagagaaagactttaaaacaaagaatggaagatatgatattagtaaaatccctgacatatatgactgtataaaatatgatgtccagcataatggttccttgaaattagaaaacacaatggaattatataggctttcgaaggcattagcagatattgttatccctcaggaatatggtataactaaagctgaaaaactggagattgccaaaggctactgtactcctctggttagaaaaattcgctcagaccttcagaggacacaagatgatgacactgtaaataaacttcatcctgtgtattctagaggtgttctgtctcctgaacgtcatgttcgtactagattatattttaccagtgaaagtcatgtacattctttgctgtctattcttcgctatggtgccttatgcaatgaatcaaaggatgaacagtggaaacgagctatggattatttaaacgttgtcaatgagctcaactacatgactcagattgttatcatgctttatgaggatcctaataaggatctttcctcagaagaacgctttcatgttgaattacactttagtccgggagccaaaggttgtgaagaagacaaaaatttgccatctggctatggatatagaccagcttccagagagaatgaaggcaggagaccttttaaaattgataatgatgatgaaccacatacttctaaaagagatgaagttgatcgagctgtgatattgtttaaaccaatggtatcagagccaattcatatacacaggaagtctccacttccaagatctaggaagacggctacaaatgatgaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtntgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaaaaaaat

SEQ ID NO: 66382 - DNA, 2350 bp, Homo sapiens
  misc_feature (813)..(813): n is a, c, g, or t
ttgccccctttctcacttccaggaagagagccccctgagtgtgtctagcccagagggtactggtacctggctgcattataccagtggtgtgggtactgggcgtcgaagacgcagatcaggggaacaaatcacttcttcccctgtctcccccaaatcattggctttcacatccagtatttttggctcatggcaacaggttgtatctgaaaatgctaattacctgagaacaccaagaactcttgtggaacagaagcagaatcctactgtagggtctcactgtgcgggcctgtttagcacctcggtgctcgggggttcttcaagcgcacctaacctacaggattatgctcgtactcatcgtaaaaagctgacctcttctggctgcatagatggctttgaattgtattccatggtgccatctatttgtcctctagaaactcttcataatgccctatctttaaagcaagtggatgaatttcttgcttccattgcttctccatcatctgacgttccacggaagaccgctgaaatttcctctacagctttacgttccagtccaataatgagaaaaaaagtatctttaaatacgtatacacctgcaaagatcctcccaacaccaccagctaccttaaagagcactaaagcaagcagcaaaccagctacaagtggaccttctagtgcagttgttcctaatacctcatctcggaaaaagaatataactagcaaaacagaaacgcatgaacacaaaaaaaacactgggaaaaagaaatgaaatcttagcagaagctggaactttttatacttataaaaatagtntgttcttatgtttctccttatgcatttatgtgttcacttaaaaatgtttttaaatctaaggttttctttgtttatgttcaggtaaggaactgttgtcatgatctggaaatgtttaaaacaatgtttgttagcattctgtgagcagcaaaacttatagtgataaaaatcgattgttgttaatatgatgtttaccatgtgcacatagtaatgaaaaggaacataaaagcccagcaggctcgtaccaaagtcacagcagtaatgctatgtactgcagagtctgatgagctggcctttgtgcacacttttattttcatgggattgcatcttagctgttaaaacttctagattgaaatttgacagccagggttacatattggggacttttaaagtgtctttccaaagagatttcattaaccgtttagattagaatatctttcccaattgttacagtgacatatatgctgcaatatttaacaactggagtattagccacatgggttattttttcaatctgtgttttgaatttttttattgtgtgttatttaaaatattacatatgcagctgggagaactacacctttgtgcacatagatttatatattaatttgtagaaaatattttctttatatatttccttaccatacaaggtgccttgttcatcaggaaaacttttgttttgtattttgacaagaaaggcaccttcagagtttctttttaagtatagttgacaagtgtataaatgttacacttactttcagagttctttttagatctaaagaagtcagttcaaaaatggaaatcaacaatgttaggagaaatctgaattctgttaagttagtaagtattatgtatagcatctgtttttaaccatttccattcttatccctagtgtatcagttgatcacactaagaaagcttaaagattgagcatttgaaataaatgctctttataaatgattagatttttgaagggatattgaaatcattgcgctgtgatttcatctgtgatgtgaaaaatcaatttattatccttggtgctttcccccccaccaatgcacaaataattgtgaacagcttgaaatgacttaaactgtaatccaaatgggacaatctgataagaatttcatgcattggtagttaaataacttaaattgctaaagctttagcttgaaatttatgtttagaaaaactattgatttcccatggtatgaatataactattgtaattcttcaaatgagactcttctcaccttaaatagtcatatattaattaacttataggaaataagcatactatatgttagctgttttaaaaggtaccagatgtaagagtcataaatatatgcaattaaagaagttcatagatttcacatgaatgtaaatgtgttatatggagacatgtcttgtaaacagttgaatgtatgtaagttttctgtttgtgaaaatgtagttaatgtactcactgtggaggtcataaggaagctactttttttttaaagtggaacctaattaaaatatttccagaatcaaaaaaaat

SEQ ID NO: 66383 - DNA, 853 bp, Homo sapiens
atctatataagtgccaataggcagctctgctaccaccactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaacttttaaaacggggtgcggggcacaggccggtaattcccaccaattttggggggcttgaaattaggacgatcctttgggcgccgaaatttaaagttaggctttgggaatttgtacgtacttgttttcggggaaacaaaaaaaaggggggggggttaaatattcctcgagggccatgttccttaccctcttttgcaaagggcctagggggctgtattaaagaaggcggcgtgttaaagttgtgtcggaatcggttggttttggaggccttctgggtgtatggacacccgattaggcggtaaaatgttttggactttgtgatgtgtagtatttgatatcgga

SEQ ID NO: 66384 - DNA, 1697 bp, Homo sapiens
tgatcagaggatccccactgtgttatacctgcactgttgtaaatacctgcactgttgttcatacctgcactgttgttcatacctgcactgttgttcataccagggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagc

SEQ ID NO: 66385 - DNA, 2628 bp, Homo sapiens
  misc_feature (2460)..(2460): n is a, c, g, or t
acgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagcaaaaaaaaaaaaaaaaaaaaaaaaaaaaaaaaaaaaggggggggggggtaaagagagatgatatccccggaggggggcgcccaaggttaagcgcgggatccccagaggttttctgggcaccaagggcgggccccatatagaggggagcgccagaatattataagagcgcaaggcgacagggcgcgcgggggtatacaaaacggcgtgggagaggggggagaaaccgggctaaacggtgggagagcatctttggggagagaggagacccttataacatctgggggggggggacaacaatatattgtgtgggggaaacaacatttaacccctatatagagagaagattttaaaagnggctctaagagcggagaactttatcacaaattttttcaacggggtcgtaaatccgtggtgtgggtgaaaaacaatcgcgtccggaaataattggttgcggggtatcgagaaaaggtttttgggtcaacacggaagatatgttattttggacgacatttttttccgagg

SEQ ID NO: 66386 - DNA, 2051 bp, Homo sapiens
acgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacgaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagc

SEQ ID NO: 66387 - DNA, 1176 bp, Homo sapiens
gcgtcgacgtcaagaagaggaaagggaggaaacctagcagaggaaagtgtaattttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagc

SEQ ID NO: 66388 - DNA, 1402 bp, Homo sapiens
acgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcttactatgttggctaagctggtctcaaactccttgcctcaggtaatccttctgcctcagcctcccaaagtgctgagattacaggcatgagccaccatgcccgacttcccgtcgac

SEQ ID NO: 66389 - DNA, 1011 bp, Homo sapiens
attctgtgacatacatattgttttaaggatgataaaggactaagtgagataatgtaggtgaagtttagtatgatgcctggctcatagttaagtgctgaattatgatagtaatcattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagc

SEQ ID NO: 66390 - DNA, 696 bp, Homo sapiens
agtatagagaaaggcagcacacttaatatttggcattgatctggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagc

SEQ ID NO: 66391 - DNA, 803 bp, Homo sapiens
acgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagcctgggcgacaagaacaagactccacctcaaaaaaaaaaa

SEQ ID NO: 66392 - DNA, 2106 bp, Homo sapiens
acgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcagc

SEQ ID NO: 66393 - DNA, 1444 bp, Homo sapiens
acgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaagttttgccctatagtgagtc

SEQ ID NO: 66394 - DNA, 1280 bp, Homo sapiens
acgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacaaaacaaaaaacttcagtgatacaacagacgttttcccttagttccccataacaaggggacagaggtgtgcagctgaagctggatcttttttctgtcctaccatacgctt

SEQ ID NO: 66395 - DNA, 1073 bp, Homo sapiens
cttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaagccttcaatcactcttctgtccttagacgacatgagagaactcacactggagagaaaccatatgaatgcaatatatgtggtaaagccttcaatagaagttacaactttagacttcatagaagagttcacactggagagaaaccatatgtatgtcctctatgtgggaaagcctttagtaaattttttaaccttagacaacatgagagaactcacactaaaaaagcaatgaatatgtaagaatcatcagctgtagcgttaacactaaatacaccaaggacaaacatactacaggaatattatgtctgtaatcagtgtggaaaagcctttatttatatttaccactttgctcaacctaaatgaattcaaggtagagagaatccagatgtatttaatgtttatggcacaaacttcagactctaggctgaccatatacaacgtgagagaatgaaactatagatcaaaggaatgtggaggagtcttcatccacagctctgttaaataaatgggagaaatcacatcacgaaaattctgtgcctgtcgtcagtgtgaaaatgcctttgctgataatttatcctctaaacaaatgagtaaaatccacaggcaagcaaccatatgtctgtaattgctgtgcactctcattcagctaagcaccaattttggtgtgtgcaagaaaattcattataaggtaactgataaaaacaggaaatatgtgaaaatattttttattaggtggatgaggcctcttgaacaattc

SEQ ID NO: 66396 - DNA, 517 bp, Homo sapiens
cttaccttagacaacatgaaagaactcacaatggagagaaaccatatgaatgtcatctatgtggaaaagccttctctcattgttctcaccttagacaacatgagcgaagtcacaatggagagaaaccacatggatgtcatctatgtgggaaagcattcactgaatcttctgtgcttaaacgacatgagagaattcacactggagagaaaccatatgagtgccatgtatgtgggaaagccttcactgaatcttctgacctcagacgacatgagagaactcacactggagaaaaaccatatgaatgccatctatgcggaaagccttcaatcactcttctgtccttagacgacatgagagaactcacactggagagaaaccatatgaatgcaatatatgtggtaaagccttcaatagaagttacaactttagacttcatagaagagttcacactggagagaaaccaacacaggcaacatagtctgaaggtgtagaaatgacgggatcctctagatgcgac

SEQ ID NO: 66397 - DNA, 2421 bp, Homo sapiens
  misc_feature (263)..(263): n is a, c, g, or t
  misc_feature (507)..(507): n is a, c, g, or t
  misc_feature (856)..(856): n is a, c, g, or t
  misc_feature (997)..(997): n is a, c, g, or t
  misc_feature (1243)..(1243): n is a, c, g, or t
  misc_feature (1245)..(1245): n is a, c, g, or t
  misc_feature (1322)..(1323): n is a, c, g, or t
  misc_feature (1345)..(1345): n is a, c, g, or t
  misc_feature (1380)..(1380): n is a, c, g, or t
  misc_feature (1433)..(1433): n is a, c, g, or t
gttgttctgaattttaataaatttcttttcaatataatttacaatattatttccatggcaacccataatttggtctattaaagtttgactgcacacaggaacttcacaaagatctcatcctgtgaccagaatctttccactaggaggccttattccttcatcaaataggtctctcctctgtatctcgaagccagtctaatgtagtccacagaaaaatgctttgtgtccttatatagagtgggaaaacccactgccactcttcngtagacaaaacagaggagtgtatgccattattttctctggagcaagataagaaatttgcctttttttcccagaaccccaaattcagtttgtaaatgtcttaattcacataaggaaattggcagataaatgttactcaataaaaaactgtgttgagtagtaaattaattcagtgatgtctccagattaatcccagtgccactgattaaaattagtgactcacaaagtttacaaaatatatatacnttttttttaatccctgaactatatatagccttactgacttcatttcaagataaacttaattctttgattatatctaatgttggactaaaagaagcatgaggggaaactatggcagaggttactagaagtgttaaggattttttaccatgaaagaatatataccttcatttgagcaaatatgatgctgtcagtttcactgatgtgttacagttattttggtgtcttttgccaactatattagattagtgcctttgtagacttatctttcatccatgatcttttcataaagaagtgtttccatggaagagacatttttgttgttgttgttgttgtttttgttttgttttgntttttacaaaatctgctgagagaaactgttctttgccctttatgtggaatatggccagctagggtaatacttcagtgcaacagagacacttaacatttgattgatgaacaacagaacctttgttcaagtggatgaagtggngtctgggtagaagtaatcaaatcttgaaagatcaaactaacctttatggtaatagcccttctttgtcctactttggtgatggttactattcaattattgtactaattagaaaaaaaataggaatatttattatgcaaattattctttcctatacttattgctatcattaagtatacaatataatagcacaattttaacattcaataaatttttatggccaggtgtggtggcagtggctcatgcctntnaccccagcatttatggaggccaaggctggctgatagcttgagctcatgagtttgggaccagcctgggcaacatggcnnaatcctgtccctacgagaaatncaaaaattagccaggtgtcatggtgtgctcctgtngtctcagctactcgggaggctgagttgggaggatggctggagcctgggaggcngatgttgcagtgagccaagattatgccactgcaccccagcctgggtgatagagccagactttgtctcaaaaataaataagtaaataaataattttaatttgttttctttttaaattgattactctttgggtgatttagttcattactgtatttacttaggaagtgcttgaaattaggatccaaagtttgttttggttttgctttttttaacctttcccaggggtaattatctctagtagctgagaaagtaaaaagttaacaagaaagttaatgcaaacaagaccagaactctgtcaccatgctgtaagaaactcaagctatgtgtagcagctacgtggaggagtcctggccaacaggctcagctgggctcccagggataattagtgtccactatcagcccagttgggttttctgaagccccagtcaacacctgactgtatgagagatcccaagggagaattaagcctttccccaaattcctgacaccccaaatcatgagcaaaataaaaatttattatattaagccagtgagtttgggagtgcaacaatagataagcagaacaaaatttggtacctggaagtgggatcctggcttaacaaaacctacaatacaggcattggttttgagaccaggtggtgttcagaaaccccgtgagttttgaggaggctgtcggtgagtttgaaagaaaatgagaaagatgtgattggaagcaggggggcagggcacctcgctatgtagtggtgaaaagtctggcgtcactgttgctgtggtaatgagggatgcaggaaatgtacctaatgaattcaatgatctagctaaaaaaaattgtcctcaggaaagtagctaaccctgctgagccttgtccacacttggacctgacttaggtgatgagatctagaccttaagccagagcctgatgaggtaattggatgaagcttctggggatcttgagagaagataagtgtatttacatttggagggaatatt

SEQ ID NO: 66398 - DNA, 434 bp, Homo sapiens
gcaggacccagtgctgaacacacacagggtaaatggtggtgtgtgaaagaccgagaaagaagctgttaattctgggcttccaatggtcagaaatgcagagatgaagggaatttgagctgagtcttgaagggtttagtaaaagggtcactgtcaaggtgaagaaaagccagtattgagggtgctgtatttgggtgagccatgcagagttagaggtgggctgaggcagagtggcctccaggagaaggtgagaggcgtgcccaggtgccaggcttgatcggcaggctgtgctcaggcccatttttctgattcattttttcttttccgcccaccctactgctgctgctttgcaaacaacacataaatctccttaggttagctgggatcccctgaaggcagtgcccactgcggcatagagaatgaagcggtgggcctta

SEQ ID NO: 66399 - DNA, 167 bp, Homo sapiens
tttggaaaaagaaatatgtgtatgcacatacagaaaaaagtctgggaggaaacagacccaactctttattgtgttactataagagagtttcagattggggaagaggggtgaagggatcatggagacattcagattttatgagcaggtatgtcttgctttataacagg

SEQ ID NO: 66400 - DNA, 233 bp, Homo sapiens
tattagaatttcctccactactgctaacactgattggaaaagcatttattaagaacccaattgatcaggcacttatgagcagactcttgacgcaaccctttagtgtcagtgaatatattttggggagcttactttattatggcatttgggttttttggtttttttttaatatgagagtcaaattgttctgattgaagctaactcagagacattattaaagcataaaacttatt

SEQ ID NO: 66401 - DNA, 441 bp, Homo sapiens
ctctttatagtcaggataactctgcagagtggatgaaattctaatgagtggaatttgttttctagtgctttactgataaggttaaccagatggtgaaatgtaatagcttggacgatgtagttttgatatacagtacatcatttctggaatgatcatgaaaaagcaaaatcaacagagctttttagattctcttttttggtcatgaaattgaaaatatacctttttagagagaaatatctcatcatagttctcctgacatttaaactgcttggctatatatttttaaaagaagacaaactgttttgaaaatgttgctataaatttttatatattgtagatttaaaaaatctcatttaaaaaatgaaagattatgaaattttttatgtcacctgaaggaatgtctatgatgtgaatttcaaataaaatagattttcttcaata

SEQ ID NO: 66402 - DNA, 370 bp, Homo sapiens
gctcttgtggttctgtggccatgagggagggacacagctagagaggacagtggggactgctgactttcaaaccctgactttcaaaactgttttaagtttttcatgcaaggtaggtgtttattgtcagaaatgttggggagggaatttctgagtctggtagaaaattggactagaaatacctccattctgtacctcatatctgcagagtagtttacaggtgtaactccacaatgaaggtgtatgaaatgtataggcattttcttatttcctctacaatttgtattattcttctatgtagcttttccctgtaaaattatacatcactgtgtctgttaccaagctaaagtaaaattactctgttttgaatgga

SEQ ID NO: 66403 - DNA, 3610 bp, Homo sapiens
  misc_feature (1)..(1): n is a, c, g, or t
  misc_feature (3)..(3): n is a, c, g, or t
  misc_feature (586)..(586): n is a, c, g, or t
  misc_feature (1180)..(1180): n is a, c, g, or t
  misc_feature (1555)..(1555): n is a, c, g, or t
  misc_feature (1871)..(1871): n is a, c, g, or t
  misc_feature (1918)..(1918): n is a, c, g, or t
  misc_feature (2255)..(2255): n is a, c, g, or t
ngnggttttttattttgacctattagtatggttaaatttatggatttactatttattgaaccatttttgcatcttggaatgagccctaattgatctgttattattttaatgtcctgatggatttactttgccaatgcatatatttaggatttttatatcaatattcataagagatcagtctatagttgttgttttttaatgtgttttgtctagttttggtattcgcatctgattgctttgtaaaaacaattgagaagtttcatttctttttctgagtttcggaacagattaaatagccaagtattatttattcttcagttaccaaattcatatttactaaacactatgtgctaggaattggactggatgctgagtaatcagtagtaaacaaaacagatatggttcctgccgtgatattgcttggctcattaaggaaaatgacattaatgaagaaactacacatatgtaattataaatcatgcaagaaaaggacaggatgctttgagataatatcattgaagatctttagattgtgctttttatgcatttgagtaaatgactattgagtacatacatatacactaanagctaattatttaaattagtatgtattgatttggtgtgtaattagggctgtggtgggtgcattagtaaaatgaggtcttcataattacacaaaatataaaataatggcaatagtagctaccattgtaggaggtagctgcatcattttttaatggtagaaattaagacaggttaagtagacacttttagtctaacatgttcaattgtatacactctttggaagtctctcttaagattatagtaaaagaataaggatataaatccacaaagatcaagaggaggtgagaggaagatatagctgaaatcagtatttgggaaactagaaaggagatgggcaagtaataaatgatttcatgaattagagaatgctgaaagctgaagagaggtaacccagcaaggagcaagcagattctttccacagaatctggaaaagttttaggaattgggggtatcaagtacaggacttctgaagtcaagaattacaggatggggtgggaatagaagggttggttgatggtctttatcattttgataccctggaaccccttctccactcccacacacccagacaactactctctcctctaccttgacngaagactgaaggtttatacccaggagactaggaggctccagatggttaaggtgggggtgaagcacctaaatgaaaatgaggattgagtgaaagtcaggtcaacatgctgaacctagagcggttgtctttttttgattggcttccaaactatcaggcttacgtgcccctcaacaaaacattaacggattcttagctggggaaacttaccagcccatggcacagtatttaacagatatgaactatggaaattcacccgattgaacagttggatccatcagatcacctggagagtacagccgctggtcaggaagcattgttcacgtaccacagcttctagtcaacttttatttcattttttgagacagggcctcactntgtcacccagattgaagtgcagtagcgccatcataactcactatagcgttgaactcctgggctcaagccatcctcccacctcagcctcctgggtagccgggaatacaggcgtatgcccccacgtccagctgatatttttattttttgtagagatggggtctcactatgttgccaggctggtcttcaactcctgggcttgtgatcttcctgccttggcttcccaaagtactgggattacaggtgtgagccactggtgcctggccctagtcagcttttaaatgcctcacatttgagtataaatgtacagccaagggtngcctgccatagaatgaaagtctctaatgaaaaagagaccaagtaggnaataaaaggagctgagtataaatagatttacttcagggaacagaagaaacttcaacaaataaaactagtatctttaaagagaagatattacatctgtgaaagatgaaaaagtttatataaaaaaaactgctgcgacagaagaaatttcttaaaaatttaatacaaggtttagataataaagctgaagaattctccccaaaaaaccagaagagcacaagaattagaaaataagagtgaaatgatgagaaaattagagggccaaccaaggaggttcttcatctaatacagtggaaggaaactatctgtgtcccagaactgaagaaggtgactttctagnttgaaagggcctattaagcgccctgatcaataaaacagaaacaaacaaaaaataaacaaaacttcattgtaccgaatgtatagttccaaaaggaacaagaccagattgattttcttcctacttctgaaaagaagaatgggggcagagaacgaggtgctagctcttaaactgcattttaacaaattcagggaaaaaggaaaccttaactttaaattgtatgcaagtgctgttaggtatccccagtgggaagttccaacagttctgtgacaaagataaagttgcgcagaagaagcatatttcaggtatctccagcaacttattcatatccagaatcagccctatccaaagagagaagtctcgtatacctggctaagactgaggagccatatggtatcaaggaaggagaaagcagaatgagaaagtgcctgggtggggcatgggggaggcagagatcttagtgctaataaagtactcctagaaatgagtgcataaccttggaaagcaagggttgtgtctctaagaggcaagcagagctggcaataaaggccctcctgaaccagattacatttggagattagataaggaacaaggcaccatattataaaacagcagtcctctgatttaggaacagagggaaccctaaagaaacatgacaagtgccctacccctccctacaccctgaatcttctgataacagtccaggataattcatctcattcagacatgtataacaaaaatagtatgtacagcatccatacagtgactgtctggtagatggtattttttatgttttatgttggttttttgttcttttatattatttttattattgaagatataattcacatgccataaaattcaccattttaaagtgtacagttgactggcttttaatttattcccaaggttgtgcaatgatcaccactaccaattgcattattgaccctagtgctttacttttccttatgttcactccatgaccctatgcagttcctttcattaaagtgacagagatatttccctactccttgactttgtgtttggctatgtgacttgctaaggtaaaagtgataacatatcagtttcaagcctaagccttaagaggccttgggtatttttatttgttctctttctatctgtgccatttccatgagaaaaacatgtctctgctagctcattggttgagggaagatgagagataggagagtgagggccaccccagctgagttaagctgaattcaatgaacactgtagagatgtgagtgataaaaaaatgattgtggttgtaagccagtgaacttcaggatggtctgttaataaacattagttaaccgaacagttatatgattaaaaat

SEQ ID NO: 66404 - DNA, 378 bp, Homo sapiens
  misc_feature (199)..(199): n is a, c, g, or t
gggacagcattctatgtgccttaagttaagaaaaatgaagaaatagggaaatatgctccaaaaaaaaaaaagaacaagacaatctcaattagaagccaaccctactgaaaggaagatatgtgatttacctaacaggacatttagaaggagtcataaagatgctcactgaggtaaggagtgcgatgcatgaacaaattgngaatatcaacaaagaggtagaaaatatttaaaatatcaaacagaaatcattgacctgaagaacacaatagccaaactaaaaaaattcagtagaggggtccaacagcagactagatcaagcagaagaaaggattagcaaacttgaagacagttcaatggaaatcatccaatctgaggaac

SEQ ID NO: 66405 - DNA, 324 bp, Homo sapiens
ggcttctagtggacagggaccggggatgataaacatcttgcactgctcttgatagactcacacaagatttgtcttgctcatattgtcctggaaaaaatgtctgtattgagaaatcctaaagagcctttaaagccaggctaagaagtttgatttttatcctaagtacagtgggaagctattggagagttgcaagctttaaaagacaatctctcaaagatcactttggctactgagtggagagtaaattgtaagggacaaaggtgaaagaggaacattcaataggaagctttttcagtgtccacaacagagatgacggtggcctag

SEQ ID NO: 66406 - DNA, 4734 bp, Homo sapiens
taagcaggagaatggcgtgaacccgggaagcggagcttgcagtgagccgagattgcgccactgcagtccgcagtccagcctgggcgacagagcgagactccgtctcaaaaaaaaaaaaaaaagattgcacagactgtttcctctccggtgcaatcccctgtcctttccacgcaaagataaccactagactgggtattctgctataacccccctccttttccttatggcttgcctcatatatgtgtattgctacacagtatattagttttgcatgtctttgaacttcctatgaatggagtcatggaggaaaaatgtcctgcaccttgctgttttcattcccctttatcccgagaggcagctctgcatcctgtggtacttcacagccttgtatgaatagagcgtcttttccttctcttttctgctgttgatggacatttcagttggttccagtgttttgctgttgcatacagttctgctgtaaactttcttgcacacatcaactggcacacatgcacacgaattctttagggtatagttaagacaatttttgagttacaggtatgcgtatctgctattttaccaagaaaagcagattgttgtttttccagctgtatgtaagaattccagtaacttcacatcctagccaacacttgatagaatcagaccttaaaatgcttaccaacattataaacttgaaatgtctgagtgattttaatttgtatttccctggtttccagtcatattgagcatcctttaatgagtttattggctatttgtatttcctctttatgaagggcctatataaatcttttgcttacttttcaatttgattgtctttttctagatttgtaagagttctagatactcatcttaaataatgtgtgttgcaaataccttctggcttgtggcttatcttttcacactttttatgattggttaaagattaatatgttgttaattttaacgattttatcctctctccttaaatgtatcagcctttatactttgagcttttatttgttagaaatctctcttggtcatttaggcagtctcctatacttactgttttctaaaagttttataattttgcttttcatatttaagttcttagtccgtgggtttggtgattgtgtagcataaagaaagagaccagatttacttgtttctgtaatacatcaccaggtgtcccagtgtcatctctggagaagtccagccttttctccactgatttgtgttgccagctatgtcaaagtgaaatttccgtaagagtgtgaatctgtttctaagctgttttgttctgttggtctctctgtctattccagtgcttcactgtctagctttaggataattgttgatagttgacttagcaggtcccctacctttttcttgtttttcaagagtgtcttgattagtggcactttattcttctttaaaatttttaaaatcagcttgtcttgttccacaaactaaccagctgggattacaggtatgagccaccgcacctggcccttgggcataaattgtaacataagtgtatgttcttcgacacatttaagagtggagtgatggtgtcataaaattaaataatgggatgttctaagtcccttaagctggacctttccaatctgtgcatcaaagctaattctgcattaaagtgcaaggacggctcacaaaccccatagttgcctgatatagattggcaggtgcattctcttggtttcgtttttattcctgctgaaatgtttaatgatcttgtgtggcgtcattctgttgccgattgtgtaagagagaagctggacctgggtggagacaggcttcttaggtggcctcagtgggctgttgggcatttatggttctgctggttgcagctgagatcttcagacagaatactcttctccttgaccagcgcttatctttcagattgtgaactaggcccagacaccattaccattcaccatctctaacattctcttattctttgactacataaggcactgtcgttctaggggaaacatgatagaggaaggaagttggttgcagaaaccattctttgaaagacttttttttttttttaacttagtcaattaaaatagtcctttaaggtgaacttagttctgagtttctggtccttttcccagatggaaaaggattttcaagaaaaaatcctgtcacttactgagcatgtgtgccggctcctttttggcacttccatcctcaccacaaccctataaaggagggagctcgtggcgaggcagcccaggtttctagataaggagagtctcgaggaggttccttaaccttcctgtggtggtttttctccattttttaaaatgaagaaacagaggccaagagaggttagggaatttgctcaaggtcgtgcagccagtggcagctgttctcactcggagttctgagagaggtaagcctcagaagccgggcatccattgtgtgtaacgtagtaacgtcttgcctgtgcatctagaaaggtacctgttatgttccgttcataggagaattgagaaaatattaatagtcacttcattttaagaactccagttgaaaaaggctagacagtcaatgtttgttcattgtttttctccattcttccccagcatgcgcgctctctcatgcacacgcacgcatgcgcacgtggctgagccaaagcctaagctgcgaattgagtttcgttaattcatgtggaggcagctgagagtgccacctggtcctgaagaaattgggatacttgtgggcacaaaggtggacctgagatcactggagccaagctggtggaagtgttgaccactgccgttggcagagagctgtcattactggtgcttcaggccacagctcagcaggctgtccttgttctgttttgttaagagcctagcagcatggctagcttgcaggcataatcccagagcctcttgctatctgcctgcaggaagtctctatgtgctccagcacactgaaggaatttggtgctcactttctcctgcttttgagctttggtcctgtgttattactaatccttagaggaagattttgactgtaaccactttcctgagtgctcttaaggcaggtccagaggattctcacagcgtgaaatgagaaaacgctcagcctcagaaaaatggaagttattcttttagtgccaaagtgtcattggaccacagtgcagcttggttaattcaggttaagacttagcccctggaacagtgtcaagccaaggcctgtgtggtttcatcatagatttgtaaaacaaaaaacacgtgtgttctggtaaattccaagcgcacattagtgcatacgtgtatgtgcaggagcactccctgtaagactcttgttctcatttcacactggcgcgtccccggggctggggaaatcattttcatttttgagagtaaccttaactaattaaatggatcaagggactctttgtgttttgttttcattttgttttgttttttactttaatgtacagataaattaagggaaataataattaccttgaataattttgattctcgtaactaattttccacctatgtgtgtttagctcaattttgaaatggttcactgaaagatttccaaatttcttatcactgaaactgagttatttcacttttatgactgttagtgactcctctgttttatgtatttctggtgcagtataattcttctatgtctgtgtgtctgtgatagatctcagttcaagttagcgtttcccgagcacccatcttgtgtcaggcactctgctaatgattgcgcaggttacaaggtttagagtggccacatcccctgttcacttgcagtttagagtccagtcggaggaaagggaggaggggaatcatgttatagacataacttgatatcctgcaggactcagtgatgtatgagcctcaaaaaggtcacagctgagtgagagagttggtaatcatggaaacaggcgcatcggaaactcgcttcctatgggtcagtaaagtgtgtatgaggtggtgtggatgacagcacatagagctggaggggtgggccagcagcaaccaggagaaggcgttccaggtgtctgcacccaaggagatcctggggtcagaggcaggacatgtgggaaaaaccattggtcccttttacccagggaaggactcaagaagccgaacgtggtaggagatggaggctcccaagccctggcagacgttacagcagcgctgagcactttcaggaccaggactccaaggtccagctctggaacgcccctctctgccctgactttggttccttcatcagcagaggggctcctgggctatgggctcaagtctgaagtcaccttaaagagaaatctctacctttctgttctccttcattgctgaggattttgacttgtgttgaaaagtttctgaagctttctgcagctggaaaatcaagcttttaaaaaagctcttgatgggccaggcttggtggctcacgcctgtaatcccagcactttaggaggccaaggcaggtggatcatgagatcaggagtttgagactagcctggtcagcatggtgaaacgccatccctactaaggatacaaaaattggccgggtgcggtggcgcgtgcctgtggttccagctgctcgggaggttgagggagaagaatcacttaaacccaggaggtggaggtgcagtgagctgagaccatgccactgcactccagcctgggcaacagagcaaggctctgttttgtttcgtttaaaaaa

SEQ ID NO: 66407 - DNA, 499 bp, Homo sapiens
ctgtgcgttagagtcatcgggagaacttgaaaatgccccaatgctggcctgtaccccagcaagtcagagcagaatccctagggtgggacatgggcatccaggccctgagaactactggactggatcaggactatgcccctagtgagagacgttgagagctgtcggtgtacagcagcacttcacactattagcacgctggagtcacatgaggaacttcagacacacagagcagaaacttgggtccaatttaattcatctggggtacaagtttccagtgtcccaggatgttaggacactaatatgcagccaaagtgggtggaagattgggctagaaaattggtgggaggtcgggatgttgaggcaaggagtattttttttgttcttttttgagatggaattttgctctgtcacccaggccgcagtgcagtgagctgagaccatgccactgcactccagcctgggcaacagagcaaggctctgttttgtttcgtttaaaaaa

SEQ ID NO: 66408 - DNA, 507 bp, Homo sapiens
tactactactaaattcgcggccgcgtcgacggcgttccaggtgtctgcacccaaggagatcctggggtcagaggcaggacatgtgggaaaaaccattggtcccttttacccagggaaggactcaagaagccgaacgtggtaggagatggaggctcccaagccctggcagacgttacagcagcgctgagcactttcaggaccaggactccaaggtccagctctggaacgcccctctctgccctgactttggttccttcatcagcagaggggctcctgggctatgggctcaagtctgaagtcaccttaaagagaaatctctacctttctgttctccttcattgctgaggcaggataatggtgtgaacccaggaggtggagcttgcggtgagacatgattgctcactgcaagcttgggtccaggtgtgttttgtgcagtgagctgagaccatgccactgcactccagcctgggcaacagagcaaggctctgttttgtttcgtttaaaaaa

SEQ ID NO: 66409 - DNA, 925 bp, Homo sapiens
  misc_feature (15)..(15): n is a, c, g, or t
tgtaccggtccggantcccgggatcacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66410 - DNA, 992 bp, Homo sapiens
  misc_feature (992)..(992): n is a, c, g, or t
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtgggacatccggtctggcattacgtgagcaaataaccgggtgggggaacgaacgaaggcccaggaatcagccctaagggccccaggagacattgggcaccaatgacacgacaggtggacaggcagcaccaaagacctccattcggggcggacccgcggcacaagagacataaagcacagcagagctacacacaatagcaagagcaggn

SEQ ID NO: 66411 - DNA, 393 bp, Homo sapiens
caagaaaattcttaacaccttctaatcttttttgttagactggggtctcactctggcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66412 - DNA, 592 bp, Homo sapiens
tacccagttacaacagctcaagggacagggactgagattctcagaactagaagactcatttgtgtttactactgacggttccaggtgccacagcaatttctcctgccctccactagtctcaacatttaaatcatgatactcccttgccaggcatggtggctcatgtgtgtaacctcggcactttgggagaccaaggcggacagatcgcttgagtccaggagttcgagaccagcctgagtaacacgagcaaaccccgtctctacaaaaaatacaaaaattagctgggtgtggtggtgcgcacctgcagtcccagctacttgggaagctgaggcaggaggatcatttgagcctgggagacagaggttgcagtgagccaaaatcacagcaatgcactcctgcctgggtgacagaatgacaacctgtctctaaataaataaataaagttactccgtatgaactttagatttttagaggggagtcaggtgtcatttaaaaggataatgcttttgcttaaatcagcatactgcttttaccttaattagtggtgttctccagagcatataaaaatggttccatttaatggctttgtaac

SEQ ID NO: 66413 - DNA, 483 bp, Homo sapiens
  misc_feature (46)..(46): n is a, c, g, or t
ttatcgagctggctaccagtttcgacggagactctcccatacagcnagcccttactggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactgaccagttgctcttccttccaagaaccttcgagatctgcggtctggggtctggtcgaaagatggcggccctcactaccctgtttaagtacatagatgaaaatcaggatcgctacattaagaaactcgcaaaatgggtggctatccagagtgtgtctgcgtggccggagaagagagtctccgtcgaact

SEQ ID NO: 66414 - DNA, 445 bp, Homo sapiens
aaacctggccctagttctagactatggaacctggcctagcctggtttgactggatgagtgattaacaggagttgctttttagcccatctctgatggtggaacaatctgatccctgtttcctctcttttagtgaaagtcgtaacttagataattacagtcatatgttgcttaaggatggggatacattccaagaaaatgcattgttaggcgattcgttgttgtgtgcacatcctgagctgcgctcacacaaacctggatggtacagcctcctacatacctaggctatatggtgtagcctattgctcctaggctacaaacccgtacatgtacctttactggatgctgtaggcagttgtaacacagtggtaggtatttgtgtatctaaacatatctagacagaaaatgaattttttagctccattataatcttttgggaccaccgctg

SEQ ID NO: 66415 - DNA, 2653 bp, Homo sapiens
aaagaaggtaggtacgaggcgggtgtgaatcggccggctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66416 - DNA, 2650 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccagccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66417 - DNA, 2558 bp, Homo sapiens
aaagaaggtaggtacgaggcgggtgtgaatcggccggcccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66418 - DNA, 5117 bp, Homo sapiens
  misc_feature (2897)..(2897): n is a, c, g, or t
  misc_feature (3015)..(3015): n is a, c, g, or t
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggcatgtggggctgggacacggggtgggggccaagagctactgtgtccgggcagagacttgggtaataaaggctgttactcgacagacacccgggccatgcatgcccccgcttcctggctctggccaagtcagtaattatgacagtcacggttcagaagctaatcaaagataatgcatcacatgtaagtgacctttgttactgatgaggcaggccaaaatctggcctttgacctcacctcaaggctccaggccaaacaccaactttggaccaagcgtgttctggtcagagtcccagagccgccccttaccatggtgccttgtggaggggactctggtggctggaggtcagcccagcttctgactgtccccctcagctgggattcctggggagatggagtcttcccactgggaatgggagcctggggctcacccttcatgctgaatactgaggtcttgtcacgaggaggtgtccccgggtcagcgcctggctctatcctgggtctggatgcagtgtagcctgtggtcattgattttatgaagtacctcggtctgctcaggctgccacaataaagaccacagacgcggtagcttacgtggcagacgcggtagcttacgtggcagaaacggattcctcactgtttcggaggcggatgagtccaggaccaaggtgccggcagctgtggcatctgacgagggttcctcctggccgtggccgctggcctcgcttgtcctcacatggcagagggcaggctctcggtatcttctcacccaggcccacccttctggcctcatttaacctttgtctaaataaggtttagaaagagaaaaaaaaactactaaagaaaaaaagctaggcttttaaagaattcaagttagttttattcaggcgcctcactgaggaatgcggactgcggcccggggcccaggagcagccttggagaggtttggctgggctgctctgagagagcggctcagcccgcagctcatctgcaggtggaggagcttcggtgcgtgctgaatcacatcgcacctgctcagatgttacattccagccaagccacactgagcctcggtgtaagagcacatgtggtcaaaggtcacagaggcgcaaccactaatgcggtcaggtgctatcttatgtgtgggaaaaggtaaggacagggtcatttatctcctaaggaatgcagcgactcgggcaagaggcaggggtggtgtgtgctcccccgttttgtcttcaaagcatctttcctgagagctacaggtagtggcagggtggagcctgtgaaaggccggcaagcagaatggcgcaaacgcagcttctcacatttgtgactttgtctcacaccttagttacttctgttaagtccccaagtgtagtcataatggagtttagggcttaaatatatgaattctgggggcacgcaaacattctgtccataatataaagcaggtcagggaagattgtttttaaacttaatttaaatagtatcatcatttagaagatctttggaaagagtgaattgcttgatattaaaactttgtcttttactttgaaataactgggttttattttttgataagaagtcccctctttctggccgggcgcngtggctcacacttgtaatcccagcactttgggaggccaaggcgggcggatcacgaggtcaggagatccagaccacggtgaaaccccgtctctactgaaaagacaaaaattagccgggngtggtggcgggcgcctgtagtcccagctgctcagagaggctgaggcaggagaatggcgtgaacccgggaggcggagcttgcagtgagccgagatcacgccactgtgctccagcctggacaacagagcgagactccatctcagaaaaaataaaaaataaaaaaagaagtctcctctttccttactctagttatgtagctcagtattaagcaacagaaaatgagactcatcgtagactcagcatagacccatcacagacctgtcagaggccgattgtaagctcgctgtagacccatgatagcagacccgtaggtcactagcactggatcaaatgcaagcttataaagcattgtatacctctattctatttgtggtttaggtcacaagctacctaactaagaagtttgctgaactacgcagccccaatgagttcaaggtgtacatgggccacggtgggaagccctgggtctccgacttcagtcaccctcattacctggctgggagaagagccatgaagacaggttggacgctctccttgtggatgatgccgcgcagggcccttcgcacgtctgacaggactctgctatatcgcgtgggcgtgtagctatgtcgggggcactgctgtatcgtgggggcgtgtagttaagtcagcatgaggacagctagtgtgtgggatgagcctggacccctggcggaccttgaacacgggcttgctgtccccagggccttgcacagcatctgactgagtgctactgagtagtggtctgagacagatccccagccttagggccccaaagctcaccgtttattttatttcatttccccccagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66419 - DNA, 3015 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacaggttggacgctctccttgtggatgatgccgcgcagggcccttcgcacgtctgacaggactctgctatatcgcgtgggcgtgtagctatgtcgggggcactgctgtatcgtgggggcgtgtagttaagtcagcatgaggacagctagtgtgtgggatgagcctggacccctggcggaccttgaacacgggcttgctgtccccagggccttgcacagcatctgactgagtgctactgagtagtggtctgagacagatccccagccttagggccccaaagctcaccgtttattttatttcatttccccccagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66420 - DNA, 2530 bp, Homo sapiens
gtcgcaccatctgcgctcttgatgtctggttcagagatggcggtcctcactagcctgtttgatcttcgttgatgactagtcccgatcgctacgttcagagtgtcgacatctatgcgtggcttcatccatgaagttgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66421 - DNA, 2519 bp, Homo sapiens
gtaaatatgctaggttgattatctcttccagtcatcacgaaaactacttcatgccttggtgaaactggcaacatgggttgtttctgaagagatacatgttttaatttatgaggtgtattttttgtgtttgtgtgtgtaatggtaatgatgatattcatactgaatttactgctacaatgttacaatctgttgccagttaaaattacccagggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66422 - DNA, 2538 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66423 - DNA, 2647 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66424 - DNA, 2449 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagacaggagaattgcttgaacatgggaggcagaggttgcagtgagccaagattgcgccactgcactccatccagtctggcgacagagcaagactctgtcgcaaaaaaagaaaaaaag

SEQ ID NO: 66425 - DNA, 2015 bp, Homo sapiens
agtaccccccaccgcaggttgcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66426 - DNA, 2030 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggagccacttcgtggaagcgggccgagcctgacta

SEQ ID NO: 66427 - DNA, 1942 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggctgaggcaggaggatcgcttgagaccaagagtttgagcctgcggtgagctgtgaatgcaccacggcactcaagcctgggcaatgtagcaagatcctgtctctacaagaaattttttaaaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66428 - DNA, 1540 bp, Homo sapiens
tcattatttatttatctcatttacttctattgctctgccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66429 - DNA, 1110 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66430 - DNA, 430 bp, Homo sapiens
  misc_feature (4)..(4): n is a, c, g, or t
gttncactctagagtatcccctgagacgaccttgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66431 - DNA, 1086 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggtatgccccccacgctgacttctgcctgagtcctgggttccatctgagccatacaaagacaggctctctgttcacacaacagcttataaagctcacaggaaaagataagacaagcgtcccccagcccttatcagcacagatgactcggatgtaagagtataggtttgttttccagctttaggaaacattcaaagtgtaattgttttacagctgcttaaaggtcacaatattggcgactcagcgtgatttttgccaccgcatgaaatgtgacttttcagtccctgcctgtctctgtgagtgtggtcccttgccagaacatagtgcaggctctgtcacatcacacaggcccctcactgtctctgtgtggtttacgtcctcctaaaaataaattctgatttttaaaatgta

SEQ ID NO: 66432 - DNA, 893 bp, Homo sapiens
ccacgcgtccgcggacgcgtgggcggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66433 - DNA, 518 bp, Homo sapiens
aaagaaggtaggtacgaggcgggtgtgaatcggccggctggtaacagggccttgcctagtgggccttccttcccaggcatggtggctcatgtgtgtaacctcggcactttgggagaccaaggcggacagatcgcttgagtccaggagttcgagaccagcctgagtaacacgagcaaaccccgtctctacaaaaaatacaaaaattagctgggtgtggtggtgcgcacctgcagtcccagctacttgggaagctgaggcaggaggatcatttgagcctgggagacagaggttgcagtgagccaaaatcacagcaatgcactcctgcctgggtgacagaatgacaacctgtctctaaataaataaataaagttactccgtatgaactttagatttttagaggggagtcaggtgtcatttaaaaggataatgcttttgcttaaatcagcatactgcttttaccttaattagtggtgttctccagagcatataaaaatggttccatttaatggctttgtaac

SEQ ID NO: 66434 - DNA, 236 bp, Homo sapiens
tttaaacaggtactgagtgtaaaacaatatgagagggtctctctcttccctcagtacaaacagtttttaaaatctttaacccaaagcacacgtgatgggtctgtcctatttccaatcagcctgttcaactgcagcagccacagagggtgagcctggaacgtggcaacgttacgggagcctcttctccctcaaggacaccttttcagaatccctcgttgcttcttgtccacaaacag

SEQ ID NO: 66435 - DNA, 363 bp, Homo sapiens
actatgtctgcatttctgacaattactggctgggaaagaagaagccctgcatcacctacggcctcaggggcatttgctactttttcatcgagggtacagtgccaagctgtacgggtcacttctttctaacccctgaatctcccggttctcccaaacgcaaagtagacaaggacccagaagtcaggtgcacaggaaggagaagcacagggctcacttagtgccccaattcccagcttccataaaccaccgtcctacaccagggtggacagcaacacttccagtgatcagaagttaatctcacagcagcatcaaggtaggacagtgtgatttgtaatgttgctttggagcggctgagaggagatt

SEQ ID NO: 66436 - DNA, 658 bp, Homo sapiens
agagcatgcgcgctggagcctgtgtggcctcttggtcaggtgcttgtggaggtttagctgatgccctttggctgtttctggactaagatcatcaactttcttaaactgaatctggttttccttgggctctgtcgtctgtgttgtgggtttgtggtggtggacacaggatgtgacattcttgctgggatccctgaagtgactatatcctctgcaataacagaaagtgaaacttatctttgtgctttaagagtgtaaaaatttttattaaagtaccagtaaaactaaaagtgcctacttttagttttcactgtattttcttcaactcaggccctccctctgttgttacctgccatctgacacggaattttgtgtaattttccttccaagtaaagaagggaagtttagccccagcctctaactggttcccaaagtttttgtctctgaagccgcagtcacttcctggagcgtctctggctgggtgttgcagtgctggctgggagggtggggcaacaatttacaattctgaacacgtgctttctgggcaggtcgcccctcagtctccactagagacaggactgaccagttgctcttccttccaagaaccttcgagatctgcggtctggggtctggttgaaagatggcggccctcactaccctg

SEQ ID NO: 66437 - DNA, 2707 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66438 - DNA, 2814 bp, Homo sapiens
tacccagttacaacagctcaagggacagggactgagattctcagaactagaagactcatttgtgtttactactgacggttccaggtgccacagcaatttctcctgccctccactagtctcaacatttaaatcatgatactcccttgccaggcatggtggctcatgtgtgtaacctcggcactttgggagaccaaggcggacagatcgcttgagtccaggagttcgagaccagcctgagtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66439 - DNA, 2918 bp, Homo sapiens
aaagaaggtaggtacgaggcgggtgtgaatcggccggctggtaacagggccttgcctagtgggccttccttcccaggcatggtggctcatgtgtgtaacctcggcactttgggagaccaaggcggacagatcgcttgagtccaggagttcgagaccagcctgatgaaagtcgtaacttagataattacagtcatatgttgcttaaggatggggatacattccaagaaaatgcattgttaggcgattcgttgttgtgtgcacatcctgagctgcgctcacacaaacctggatggtacagcctcctacatacctaggctatatggtgtagcctattgctcctaggctacaaacccgtacatgtacctttactggatgctgtaggcagttgtaacacagtgccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66440 - DNA, 2683 bp, Homo sapiens
aaagaaggtaggtacgaggcgggtgtgaatcggccggctggtaacagggccttgcctagtgggccttccttcccaggcatggtggctcatgtgtgtaacctcggcactttgggagaccaaggcggacagatcgcttgagtccaggagttcgagaccagcctgaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66441 - DNA, 2774 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaaaaacagacatgaacacaacgagtccacccaacacacacacaacaatacaacaacaacaacaaggggg

SEQ ID NO: 66442 - DNA, 3002 bp, Homo sapiens
aaacctggccctagttctagactatggaacctggcctagcctggtttgactggatgagtgattaacaggagttgctttttagcccatctctgatggtggaacaatctgatccctgtttcctctcttttagtgaaagtcgtaacttagataattacagtcatatgttgcttaaggatggggatacattccaagaaaatgcattgttaggcgattcgttgttgtgtgcacatcctgagctgcgctcacacaaacctggatggtacagcctcctacatacctaggctatatggtgtagcctattgctcctaggctacaaacccgtacatgtacctttactggatgctgtaggcagttgtaacacagtgccttcgagatctgcggtctggggtctggttgaaagatggcggccctcactaccctgtttaagtacatagatgaaaatcaggatcgctacattaagcctgttcaactgcagcagccacagagggtgagcctggaacgtggcaacgttacgggagcctcttctccctcaaggacaccttttcagaatccctcgttgcttcttgtccacaaacagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66443 - DNA, 2673 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtatacacctatcccccattctcctcctatccctcaaccccggcatcattaccgggttttcctttta

SEQ ID NO: 66444 - DNA, 2188 bp, Homo sapiens
  misc_feature (46)..(46): n is a, c, g, or t
ttatcgagctggctaccagtttcgacggagactctcccatacagcnagcccttactggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66445 - DNA, 2928 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgagggtacagtgccaagctgtacgggtcacttctttctaacccctgaatctcccggttctcccaaacgcaaagtagacaaggacccagaagtcaggtgcacaggaaggagaagcacagggctcacttagtgccccaattcccagcttccataaaccaccgtcctacaccagggtggacagcaacacttccagtgatcagaagttaatctcacagcagcatcaaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66446 - DNA, 1871 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctctttggtggacaagagggggaacatcctgatccccggcattaacgaggccgtggccgccgtcacggaagaggagcacaagctgtacgacgacatcgactttgacatagaggagtttgccaaggatgtgggggcgcagatcctcctgcacagccacaagaaagacatcctcatgcaccgatggcggtacccgtctctgtccctccatggcatcgaaggcgccttctctgggtctggggccaagaccgtgattcccaggaaggtggttggcaagttctccatcaggctcgtgccgaacatgactcctgaagtcgtcggcgagcaggtcacaagctacctaactaagaagtttgctgaactacgcagccccaatgagttcaaggtgtacatgggccacggtgggaagccctgggtctccgacttcagtcaccctcattacctggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66447 - DNA, 1331 bp, Homo sapiens
aattcgcggccgcgtcgaccgacagaagggggctgggagaagagccatgaagacagtttttggtgttgagccagacttgaccagggaaggcggcagtattcccgtgaccttgacctttcaggaggccacgggcaagaacgtcatgctgctgcctgtggggtcagcggatgacggagcccactcccagaatgaaaagctcaacaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttgagactgagagttggaggctgcgatgagccatgaatgccccactgcactccagcctgggcgacagaacgagaccccatctcaaaaaaaataagttctggttgtcattgaattgggataaacagagagcttgatgctttctgccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccctcaaaacctcactaactggaaggatgattttgtctcagtttgtactcctaaataaaaagtaaacatgacacctctaaaa

SEQ ID NO: 66448 - DNA, 1118 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccaggagattcctgtcaacgtccgattctgcctcgaaggcatggaggagtcaggctctgagggcctagacgagctgatttttgcccggaaagacacattctttaaggatgtggactatgtctgcatttctgacaattactggctgggaaagaagaagccctgcatcacctacggcctcaggggcatttgctactttttcatcgaggtggagtgcagcaacaaagacctccattctggggtgtacgggggctcggtgcatgaggccatgactgatctcattttgctgatgggctcttgggtggcagagggggacctctgtcccggttacgagccgggcgcgtcggagaggcccagcgtcgcgactccttgctacggttgcccgctggggggcccccgggccaagaccccggcgggggccctccccgaggccccggggcccctccg

SEQ ID NO: 66449 - DNA, 876 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggcaagctgtatgggagaggttcgactgatgataagggcccggtggccggctggataaacgccctggaagcgtatcagaaaacaggccagctgcttaaaggtcacaatattggcgactcagcgtgatttttgccaccgcatgaaatgtgacttttcagtccctgcctgtctctgtgagtgtggtcccttgccagaacatagtgcaggctctgtcacatcacacaggcccctcactgtctctgtgtggtttacgtcctcctaaaaataaattctgatttttaaaatgta

SEQ ID NO: 66450 - DNA, 801 bp, Homo sapiens
agcggggtggtggccagggcgaccgcggggcgggccagcgccgggggtcgtggccaggacacgtggtacggaaccggcgccgcgcttgctgctggtaacagggccttgcctagtgggccttccttcccaggtcgcccctcagtctccactagagacaggactgaccagttgctcttccttccaagaaccttcgagatctgcggtctggggtctggttgaaagatggcggccctcactaccctgtttaagtacatagatgaaaatcaggatcgctacattaagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaaggtaggaggcaacattctttgcattgcaggaccgtagacagattctgcctgaggggttgacaagacgccacaagttcttaaaagatcttttgcttcacataccccactcacctttaaaacaaaaaaggaagggcctgatttggatggtaagttctgtacgtgactgcttcagttggattggggcaaaggttttgtggcactcagcatttttctccaggaaggagaactgctgacagttactcaggactaagttaatgtaacagtcattctgagagaatggctgagattcccctcccagcaatccataagctttcaaactaggaagttacactttattcaagtccatttaaaaattataaagactccccccaacccc

SEQ ID NO: 66451 - DNA, 538 bp, Homo sapiens
ggcccccaagctgggatgggggatgctccccaggaagaaggcagagtgtgtctgggctcgggaggagtcaccccacacctgggtgttggctcacgacaccagccaacacaatgatgtgttcctctctaccaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggctgggcaccacggctcacacctataatcg

SEQ ID NO: 66452 - DNA, 2111 bp, Homo sapiens
  misc_feature (16)..(16): n is a, c, g, or t
  misc_feature (19)..(19): n is a, c, g, or t
  misc_feature (48)..(48): n is a, c, g, or t
  misc_feature (100)..(100): n is a, c, g, or t
  misc_feature (1236)..(1236): n is a, c, g, or t
  misc_feature (1762)..(1762): n is a, c, g, or t
ggcacccaggcctgtnagngaggctggtcccatggccttcctcttccnccaccaccaccggctgcccaggtggcccccatcgtgtccccagggaacgctnggccatggccacaaggggctcatggagagggcagcctggctccctcccaggccaaggcccggccggacgactcctgtaaacccaagagtgtctatgagaacttccgactctggcagcactacaagcccctggcccggaggcaccttccccagagtcctgacactgaagcgctttcctgcttcctcatcccagttctccgatccctggcccggcggaagcccaccatgacgctggaggagggactgtggcaggccatgcgggaatggcagcacacgagcaactttgaccggatgatcttctacgagatggcggaaaagttcctggaatttgaggctgaggaggagatgcagattcagaaatcgcagtggatgaaggggccccagagcctgcctcctccagccccgccgaggcttgaacctcgaggaccccctgcccctgaggtggtcaagcagccagtgtaccttcccagcaaggatggccccaaggccccgactgcctgcctgccaccacccaggccccagaggccagcggagaccaaggcccacctgccaccacccaggccccagaggccagcggagaccaacgcccacctgccaccacccaggccccagaggccagcggagaccaaggtccctgaggagatcccccctgaagtggtgcaggagtatgtggacatcatggaggagctgctggggtctcaccctggggacacaggggagcctgagggacaacgggaaaagggcaaagtggagcagccgcaggaagaggacgggataacctcagacccgggcctcctgagctacattgacaagctgtgttcccaggaagactttgtcaccaaggtggaggccgtcattcacccccgattcctggaagaattgctttccccagatccacagatggatttcttggccctaagccaggagctggagcaggaggaaggactcacccttgcccagctagtggagaagcgcctcctgtccttgaaggagaaagggtgcgggagggcagcccctcgacatggcacggccaggttggactcaagtccttctgagtttgcagctggccaagaagcagcgagagaggtccctgacccccaacaaagggtcagcgtggaaacctccccaccccagacngctgcccaggaccctcagggacagggcagagtgcgcactggcatggccaggtccgaagaccctgctgtgcttttgggatgtcaggattcccccaggctgaaggctgtccggccaacctctcctccccaggaccacagacccacctgccccggcctggggaccaaggacgccttgggtctccctggagagtctcctgtcaaggagtcacatgggctggctaaggggtcaagtgaggagacggaactccctggcatggtctatgtcgtgggttcccaccacaggctgaggccctggaggctgtcccagagccctgtcccttcctcgggccttctcagcccaggagggagaggaccccagggagctcttcagtctccatctgctcagaaaagaggcctcagcccatcacctcctgccagcaagtccaagaagcgacctctctttggaagcccatcccctgctgaaaagacaccgcacccagggcctgggctcagggtctctggggagcaatccctggcttgggggctgngtggcccctcacagtctcaaaagagaaagggtgaccccttggcctccaggaggaagaagaagcggcattgtagccagtaggggccgccatggggcagactctctgatgccagtccccaaaagtggggctctgaagtctcggaccctcatggcacccggtgccccaaagcaaaggctgcttctcctccagtgctgatcttgctgggccttagctttggagggtaggggaaggaggggagggagaaggtggctgaacggggagggcaggaagggagggcctggggggtgggaagcagtgccttgggggccttgtgtgtaaatgtgaataaatgtagttgttttggaaaatg

SEQ ID NO: 66453 - DNA, 415 bp, Homo sapiens
ttttgctgtttgtgcttttggtgtcatacattcagaatgctttgcctcctccaaagtcatcaacatttattactgtatttctttttaagaattttatagtttgagcccttgtatttaggtctatgatccatattgggttaactttgtgtactgtgttgttgtaggtgcccaaattctttctcttggacgtggatatccagttgctccagcaatatttgtcaaaatggctattttttccctatcaaattctcttgaaatccttgtcaatatcaactgatcctaaatgctcattactgaactctcattccattccatttcattgacaaatatgtctacacttatgccagtactgctctatcgtaattactgtagctttatggtaagttttgaaatcagtaagcatgagtcctctgac

SEQ ID NO: 66454 - DNA, 1325 bp, Homo sapiens
  misc_feature (1209)..(1209): n is a, c, g, or t
  misc_feature (1217)..(1217): n is a, c, g, or t
  misc_feature (1280)..(1281): n is a, c, g, or t
  misc_feature (1283)..(1283): n is a, c, g, or t
  misc_feature (1323)..(1324): n is a, c, g, or t
ccaggctctagggacagaaccttcccaaggcgggggggaggggagactctgattttcccgccgaaagcgtccccttggattggctactttaaattcagagtacgcacacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccantgccatgngtcctggtcaagcccccctcactctgtttcctgttcagcatgtactcccctcatccgattccnntntatcagtcactgacagttaataaacctttgcaaacgttcnnc

SEQ ID NO: 66455 - DNA, 984 bp, Homo sapiens
  misc_feature (868)..(868): n is a, c, g, or t
  misc_feature (876)..(876): n is a, c, g, or t
  misc_feature (939)..(940): n is a, c, g, or t
  misc_feature (942)..(942): n is a, c, g, or t
  misc_feature (982)..(983): n is a, c, g, or t
gactcacaacctctgctgcagaatgccctcatgcgacagaagtctctctagagtttggaaatctttaccaacaaagaaaaattctgatgtattctctttcagttgaacgtcctcagatgactttcggcagcctccagagaatcttcccgaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccantgccatgngtcctggtcaagcccccctcactctgtttcctgttcagcatgtactcccctcatccgattccnntntatcagtcactgacagttaataaacctttgcaaacgttcnnc

SEQ ID NO: 66456 - DNA, 1718 bp, Homo sapiens
agccgagcgccgactcacgccccagccccaattgggcggccggtttccaattggaagggcttctgagcctcagtcttcgggcggcgctgaccattggcgggcaggatggaggcggagccttgggtcgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66457 - DNA, 888 bp, Homo sapiens
  misc_feature (786)..(786): n is a, c, g, or t
gaaaaggtagtagcaggctgtgtgttgaatcggacgagcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggctgtggggtgatcttgnttccacaactcctggccttggcctccgcccaccccttctgggccaccccgcgccggccaggcaattccgtcggactcggtcgacccgccactggatcactgg

SEQ ID NO: 66458 - DNA, 1585 bp, Homo sapiens
gctggtacaggtcccaaggcgtatgatcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66459 - DNA, 1853 bp, Homo sapiens
agccgagcgccgactcacgccccagccccaattgggcggccggtttccaattggaagggcttctgagcctcagtcttcgggcggcgctgaccattggcgggcaggatggaggcggagccttgggtcgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccagggaaaaaaaaaaaatatttttatatataaattttatttagtgttagttttcccaaaaaacctctgggggcggcctggtaccaaatttgcccttatttgggtgtttttatgggcccctttttgccagtgtgtaaaaagg

SEQ ID NO: 66460 - DNA, 1787 bp, Homo sapiens
agccgagcgccgactcacgccccagccccaattgggcggccggtttccaattggaagggcttctgagcctcagtcttcgggcggcgctgaccattggcgggcaggatggaggcggagccttgggtcgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctggtgagcgggggctgagaggacagtaggggaggcccaagagctgcccctcatgctctgggtctctcctagatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66461 - DNA, 1552 bp, Homo sapiens
cccaccccccaggaccctggcgccccagctgcaagggctgcgcccccgggagccgccatgcgggtcgtctcagagcctgtgggcctccctgccctcactgccctcctgcctccgcgcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggagtcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66462 - DNA, 1508 bp, Homo sapiens
gctggtacaggtcccaaggcgtatgatcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66463 - DNA, 775 bp, Homo sapiens
gaggctacttagaggatccccattggatagcggatggggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66464 - DNA, 1010 bp, Homo sapiens
  misc_feature (908)..(908): n is a, c, g, or t
agccgagcgccgactcacgccccagccccaattgggcggccggtttccaattggaagggcttctgagcctcagtcttcgggcggcgctgaccattggcgggcaggatggaggcggagccttgggtcgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggctgtggggtgatcttgnttccacaactcctggccttggcctccgcccaccccttctgggccaccccgcgccggccaggcaattccgtcggactcggtcgacccgccactggatcactgg

SEQ ID NO: 66465 - DNA, 1142 bp, Homo sapiens
  misc_feature (868)..(868): n is a, c, g, or t
  misc_feature (870)..(870): n is a, c, g, or t
  misc_feature (965)..(965): n is a, c, g, or t
  misc_feature (990)..(990): n is a, c, g, or t
  misc_feature (1049)..(1049): n is a, c, g, or t
  misc_feature (1086)..(1086): n is a, c, g, or t
  misc_feature (1092)..(1092): n is a, c, g, or t
  misc_feature (1139)..(1139): n is a, c, g, or t
agccgagcgccgactcacgccccagccccaattgggcggccggtttccaattggaagggcttctgagcctcagtcttcgggcggcgctgaccattggcgggcaggatggaggcggagccttgggtcgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcagtgaggctgtcttccttgctcctgttagcagacgacctcccacctcctgctggccctgcccatagcccacttccgccaacattgcctccacacctctcctcccttcattccactaaagagtggccatccgttgggcgcccactgcctcctctggttctcctttcttcccagtaacagcccgctgctgtcccagggtggccaagccccgttaatgtgcatccactcctttccatctctgtctctctgcctctcttcctctctccctagtcaccctcatcgattcctacgagtcttctagcttcatgttcctggtgtttgacctgtgagtatctccctgccaccatctgagaagcctccncnccacctccatgtatggcccagcatttgtggtgcagtgggctggacccatcctgctcacaccttcctgttccagctggggctctctatcacctggncctgcctgctagcgcatggctctgnccttctcccttggtgccatgattgaggcaaattctttaatagtgactagtggctgggtncagtggctcacgcctgtaatcccagcactttgggagnccgagncgggtggatcatgaggtcaggagatcgagaccatcctggctaacacngtg

SEQ ID NO: 66466 - DNA, 201 bp, Homo sapiens
tatgcagatccgactttcagatttcgggttctcctgccacttggaacctggcgagaagcttcgaggtgaggggatctagtgccctaataggcttgggaggggagacccaggcctgatgagattggttggctgggtctgagtaccaagtccctggtgccaagaaaaagggagaagtcattgggcacttgccaagtatcctgt

SEQ ID NO: 66467 - DNA, 721 bp, Homo sapiens
ttttttgcgtatgtattatgatgtatgtaaaaatacataatctttccatatgcattatgatatatataaaactaaggtaacaagttgtgaggagtgggtaggttggcttggatagtgggtaggtagggttggaggaggcaaatgatatggtggaacaaggaccttgaaatcaatccaaaacccaggttttcctaggaaggccaccaggagccatggtgagccaactgttgcgcagggatagtgcctcagcaggagacttggcagaaggcagacagaaggaagatgggaacactggtagtcctggcagcgttgaggaggctccagcagagatccagtgctaagggccctagaggggctggtggcatcccctcaatcttggtcctctctccccagagttgtgtgggaccccagggtatctagcgccagagatccttaaatgctccatggatgaaacccacccaggctatggcaaggaggtcgacctgtgagttcctggtctccccctccctcccgtgcttgctgtcctttgctgggtctgcccgtcacctagtcccgcctgactccagtctctttcccagctgggcctgtggggtgatcttgttcacactcctggctggctcgccacccttctggcaccggcggcagatcctgatgttacgcatgatcatggagggccagtaccagttcagttcccccgagtgggatgaccgttccagcactg

SEQ ID NO: 66468 - DNA, 1585 bp, Homo sapiens
ggctggtacgccccggatagtacgggacaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66469 - DNA, 1985 bp, Homo sapiens
agccgagcgccgactcacgccccagccccaattgggcggccggtttccaattggaagggcttctgagcctcagtcttcgggcggcgctgaccattggcgggcaggatggaggcggagccttgggtcgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcagtgaggctgtcttccttgctcctgttagcagacgacctcccacctcctgctggccctgcccatagcccacttccgccaacattgcctccacacctctcctcccttcattccactaaagagtggccatccgttgggcgcccactgcctcctctggttctcctttcttcccagtaacagcccgctgctgtcccagggtggccaagccccgttaatgtgcatccactcctttccatctctgtctctctgcctctcttcctctctccctagtcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66470 - DNA, 1657 bp, Homo sapiens
agccgagcgccgactcacgccccagccccaattgggcggccggtttccaattggaagggcttctgagcctcagtcttcgggcggcgctgaccattggcgggcaggatggaggcggagccttgggtcgtcgcccgccgccgggggttaaggtgagcgactggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66471 - DNA, 1616 bp, Homo sapiens
cccaccccccaggaccctggcgccccagctgcaagggctgcgcccccgggagccgccatgcgggtcgtctcagagcctgtgggcctccctgccctcactgccctcctgcctccgcgcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcatcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66472 - DNA, 2032 bp, Homo sapiens
agccgagcgccgactcacgccccagccccaattgggcggccggtttccaattggaagggcttctgagcctcagtcttcgggcggcgctgaccattggcgggcaggatggaggcggagccttgggtcgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcagtgaggctgtcttccttgctcctgttagcagacgacctcccacctcctgctggccctgcccatagcccacttccgccaacattgcctccacacctctcctcccttcattccactaaagagtggccatccgttgggcgcccactgcctcctctggttctcctttcttcccagtaacagcccgctgctgtcccagggtggccaagccccgttaatgtgcatccactcctttccatctctgtctctctgcctctcttcctctctccctagtcaccctcatcgattcctacgagtcttctagcttcatgttcctggtgtttgacctcccccactgtgggatgcagctgcctcctatgcccctccttcccttaggatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66473 - DNA, 2265 bp, Homo sapiens
agcaggctggtacggtccgaagtcttagatccaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacagagcgagactctatctccaaaaaaaaagagagtgttcagcagtggactgaccacttagaaaatagatcctcactcaccagcctctcgcgctgcttaacacgctaactattctggtgtctgtctctgcccatcagttctttttctggtcagaatctgaatgtccgatgcaattggtataatgcaaaccaactgcaaaggtattttgaaagagaatgatttgaattccaaagatttaaaagaggcccttggaaaaaattcatgaaggcttcgatatatttacagaaatggccctctgcaaaagtcagaggggacgtaaggatgtctattatgccatcctgcagccatgcagagtgcctacactccccaaaacagcacctgataatgttactttgaggactgatgcagagtgcaagtataacctcaattttgaaagtattatttttaattgacacataattataacctcagcttttaaagacgaaacttcaaaataaggtcctattcaacctttgtgccacaaaaaactgaaattttggtccattttctttatagattcactttgagaggcctttttcaggcatagttactctcaacaagaacctcctataaattatattgtcacaagaagtctcttatttttgccataattgccccatcatggcataatgcaggtatttcagctgccaacacaccaggccaaactgccttgttggagtgctgtgtttctagaccctttggtttgtctgcagagatctatctttagtggcctcttccacaatattttgtatgagcactggtctgtcttctcagcccccactgtgggatgcagctgcctcctatgcccctccttcccttaggatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66474 - DNA, 1173 bp, Homo sapiens
gatatggtggaacaaggaccttgaaatcaatccaaaacccaggttttcctaggaaggccaccaggagccatggtgagccaactgttgcgcagggatagtgcctcagcaggagacttggcagaaggcagacagaaggaagatgggaacactggtagtcctggcagcgttgaggaggctccagcagagatccagtgctaagggccctagaggggctggtggcatcccctcaatcttggtcctctctccccagagttgtgtgggaccccagggtatctagcgccagagatccttaaatgctccatggatgaaacccacccaggctatggcaaggaggtcgacctctgggcctgtggggtgatcttgttcacactcctggctggctcgccacccttctggcaccggcggcagatcctgatgttacgcatgatcatggagggccagtaccagttcagttcccccgagtgggatgaccgttccagcactgtcaaagacctgatctccaggctgctgcaggtggatcctgaggcacgcctgacagctgagcaggccctacagcaccccttctttgagcgttgtgaaggcagccaaccctggaacctcaccccccgccagcggttccgggtggcagtgtggacagtgctggctgctggacgagtggccctaagcacccatcgtgtacggccactgaccaagaatgcactgttgagggacccttatgcgctgcggtcagtgcggcacctcatcgacaactgtgccttccggctctacgggcactgggtaaagaaaggggagcagcagaaccgggcggctctctttcagcaccggccccctgggccttttcccatcatgggccctgaagaggagggagactctgctgctataactgaggatgaggccgtgcttgtgctgggctaggacctcaaccccagggattcccaggaagcagaactctccagaagaagggttttgatcattccagctcctctgggctctggcctcaggcccactaatgatcctgctaccctcttgaagaccagcccggtacctctctccccactggccaggactctgagatcagagctggggtggaagggagccattctgaacgccacgcctggcccggtcagtgctgcatgcactgcatatgaaataaaatctgctacacgccaggga

SEQ ID NO: 66475 - DNA, 1455 bp, Homo sapiens
agccgagcgccgactcacgccccagccccaattgggcggccggtttccaattggaagggcttctgagcctcagtcttcgggcggcgctgaccattggcgggcaggatggaggcggagccttgggtcgtcgcccgccgccgggggttaaggtgagcgactgcaggcaaacccggcgacagcgcagctcgcgtcgaccctggctcctctgcctgccccctcaggcccccgcctccttcaggatgacgctggacgtggggccggaggatgagctgcccgactgggccgccgccaaagagttttaccagaagtacgaccctaaggacgtcatcggcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcagtgaggctgtcttccttgctcctgttagcagacgacctcccacctcctgctggccctgcccatagcccacttccgccaacattgcctccacacctctcctcccttcattccactaaagagtggccatccgttgggcgcccactgcctcctctggttctcctttcttcccagtaacagcccgctgctgtcccagggtggccaagccccgttaatgtgcatccactcctttccatctctgtctctctgcctctcttcctctctccctagtcaccctcatcgattcctacgagtcttctagcttcatgttcctggtgtttgacctgatgcggaagggagagctgtttgactatctcacagagaaggtggccctctctgaaaaggaaaccaggtccatcatgcggtctctgctggaagcagtgagctttctccatgccaacaacattgtgcatcgagatctgaagcccgagaatattctcctagatgacaatatgcagatccgactttcagatttcgggttctcctgccacttggaacctggcgagaagcttcgaggtagacagtgagctcggtaagggctcatctcatttgccacttggcaaatcaatgcaacttggcattcaagaaatacttggtgtaggaatgaatttcccaacaaagtcagtttcaattcggggctgttaaaatctcctggaagtgtgccatggaacaaggttcagaaagtactggaagaattggtgcccgagtggtagaacaaactaaaaatacagacttgagccaagcgtggtggcacgcatctgtcaccccagctactcgggaggctgaaggaggaggctcacttgagcctaggagcccaaggctacaatgagctgtgatagtgccaccacactccagcctgtgtgacatagcgaccctgtctctaaaaataaataaatataaaaatacaaa

SEQ ID NO: 66476 - DNA, 1013 bp, Homo sapiens
attctccttgtgtagttcaaaaaaatctcctctggtaatactgaaacaactaatttttcttattttgtttgttcctctttattattaaatactatgtgaattaactctttagtagttggcctggttgaagctctgtgaggagcaaagcagccctctccaggtgaactgcttgactttaccacctgaaggagtatttactgcaagaattaacaaagcaggtgttcctgatccaagcagaaccctgttatttgaagagcctgagaaatcttatcccgtttacaaatgtcctgggagtgcatccaaagtgaaacttgggtatcctcaatactaagaaatctctgagaatgactgggtcttggctctttgatcttacctctactcctctgaaaaacatgattatctaaaattgtgttaggtggatgaaccgcatcaaagacttccagaagccactccagtgaccataagataaatgtcagaatcgcataacccccaggatcaggcaagtgttatcctctcttaaaactctttgtttacaaccatgatctccttttgggaatcattacatttgacttactgcttatttttgttgaatgttaccagtgcttggtgataaaacttgatgtggctctttgctttgaaaaagaaaaaaactttttattaaaagaaacagttgtatacactgcataaaaattgggaaaatattatgaagaaaaagaagatataataaaggaaacaaaaatttacagatgaccccaaatctcttttaatatttggcaagtttcaagcatgaattttttgttttgttttgtttttgttttatagagacagcaccttgctatgttgcccaggctagtctttttttttttttgagacggagcctcgctctgttgcccaggctggagtgcagtggcgcaatcttcgctcactgcaagctctgcctcccgggttcatgccattctcctgcctcagcctcccgagcagccgggactacaggcgctcgccatcacgcccgg

SEQ ID NO: 66477 - DNA, 858 bp, Homo sapiens
gggcatcccgcgtccacgccgcggggaggagggtttcaccgtctccagggacttggctcgaggaaattaaactctaatgagtagctcgagaaatgttccgggatggtggatgagcgatcatccttaaaagaaaatgctattctgggagctccaacctgcaattaacctacagaaggaaccttttgagaggctggtgcagcgcttcggggaggcagattaagaactgtgttcctgatccaagcagaaccctgttatttgaagagcctgagaaatcttatcccgtttacaaatgtcctgggagtgcatccaaagtgaaacttgggtatcctcaatactaagaaatctctgagaatgactgggtcttggctctttgatcttacctctactcctctgaaaaacatgattatctaaaattgtgttaggtggatgaaccgcatcaaagacttccagaagccactccagtgaccataagataaatgtcagaatcgcataacccccaggatcagcctgttgctcaggctggagtgcaatggcacgatctgagctcactgcaaccacctgcctcccgggttcaagctattctcctgcctcagcctcctgagtagctgggattacaggcgcctgcaaccacacccagctaatttttgtacttttagtagagatggggttttgccatgttggccaggctggtctcgaactcttgacctcaggtgatctgcctgcctcagcctcccaaagtgctgggattacaggcttgagccaccgagcctggcctctactttttattactgtcatgtagttagtgataaaatgcttctatctgaaaaaaaatttgttgttctaaattctaaaaaattc

SEQ ID NO: 66478 - DNA, 616 bp, Homo sapiens
attctccttgtgtagttcaaaaaaatctcctctggtaatactgaaacaactaatttttcttattttgtttgttcctctttattattaaatactatgtgaattaactctttagtagttggcctggttgaagctctgtgaggagcaaagcagccctctccaggtgaactgcttgactttaccacctgaaggagtatttactgcaagaattaacaaagcaggtgttcctgatccaagcagaaccctgttatttgaagagcctgagaaatcttatcccgtttacaaatgtcctgggagtgcatccaaagtgaaacttgggtggatgaaccgcatcaaagacttccagaagccactccagtgaccataagataaatgtcagaatcgcataacccccaggatcagagatggagtctcgctctgtcacccagcctggaatgtagtggcatcattgtaactcactgcagcctgaaactccttggcttaagtgatcctcccacctcagcctcccaagtagctggaactataggcacaagctaccatgcctggctattcttttttgttaattttttttaaactaaggaatgaagaaaataaaacattacatgactggtacaattta

SEQ ID NO: 66479 - DNA, 723 bp, Homo sapiens
gggcatcccgcgtccacgccgcggggaggagggtttcaccgtctccagggacttggctcgaggaaattaaactctaatgagtagctcgagaaatgttccgggatggtggatgagcgatcatccttaaaagaaaatgctattctgggagctccaacctgcaattaacctacagaaggaaccttttgagaggctggtgcagcgcttcggggaggcagattaagaactgtgttcctgatccaagcagaaccctgttatttgaagagcctgagaaatcttatcccgtttacaaatgtcctgggagtgcatccaaagtgaaacttgggtatcctcaatactaagaaatctctgagaatgactgggtcttggctctttgatcttacctctactcctctgaaaaacatgattatctaaaattgtgttaggtggatgaaccgcatcaaagacttccagaagccactccagtgaccataagataaatgtcagaatcgcataacccccaggatcagagatggagtctcgctctgtcacccagcctggaatgtagtggcatcattgtaactcactgcagcctgaaactccttggcttaagtgatcctcccacctcagcctcccaagtagctggaactataggcacaagctaccatgcctggctattcttttttgttaattttttttaaactaaggaatgaagaaaataaaacattacatgactggtacaattta

SEQ ID NO: 66480 - DNA, 452 bp, Homo sapiens
  misc_feature (447)..(449): n is a, c, g, or t
  misc_feature (451)..(451): n is a, c, g, or t
ctgcgttcggacccgtctgatcgtaaatcccatgtaaggtacctgccgtcggaagatttgaacgttctacttggacacctaaaacccacagtcctccagacagaaagacaacaggtacaaagccctaaggattataaaggtatgctgcttaccatcatcttagtgaccaaggcagcgaagctgtttctgtaccttggaacagtcttccctgacaagccagagaacagtgataaagccaccagccttgggatcaggactgaaaaggcaagagtgatggagatttctcctgcgctaagccaagagaaggtttcagcacttcagacagctcccaccgaagtagccgcgctcccagctgcttgcagatgttgaaaaggaaagcctcggtttgtcttgaggttgtcagcaggtgcaagacacgtaataaaatgcaatgtgttcctaaaaaannnana

SEQ ID NO: 66481 - DNA, 491 bp, Homo sapiens
  misc_feature (486)..(488): n is a, c, g, or t
  misc_feature (490)..(490): n is a, c, g, or t
gggactggctctcagtaatcccacgtaaggtacctgccgtcggaagatttgaactttctacttggacaactaacacccacagtcctccagttcccgagctgcgttcggacccatgtcttattgtaaatcccacgcaagacagaaagacaacaggtacaaagccctaaggattataaaggtatgctgcttaccatcatcttagtgaccaaggcagcgaagctgtttctgtaccttggaacagtcttccctgacaagccagagaacagtgataaagccaccagccttgggatcaggactgaaaaggcaagagtgatggagatttctcctgcgctaagccaagagaaggtttcagcacttcagacagctcccaccgaagtagccgcgctcccagctgcttgcagatgttgaaaaggaaagcctcggtttgtcttgaggttgtcagcaggtgcaagacacgtaataaaatgcaatgtgttcctaaaaaannnana

SEQ ID NO: 66482 - DNA, 1969 bp, Homo sapiens
  misc_feature (118)..(119): n is a, c, g, or t
  misc_feature (381)..(381): n is a, c, g, or t
  misc_feature (515)..(515): n is a, c, g, or t
  misc_feature (654)..(654): n is a, c, g, or t
  misc_feature (720)..(720): n is a, c, g, or t
  misc_feature (746)..(746): n is a, c, g, or t
  misc_feature (807)..(808): n is a, c, g, or t
  misc_feature (1331)..(1331): n is a, c, g, or t
  misc_feature (1352)..(1352): n is a, c, g, or t
  misc_feature (1964)..(1966): n is a, c, g, or t
  misc_feature (1968)..(1968): n is a, c, g, or t
ggctctcagtccccgcctcgcggggggtgcctcccacctctgcgatgggggtcctaagagccagtgggggaaccaggggctggctctcaatctctgcctcgggggggtgcctcccccnncctgcgatgggggtaccaacagccaggggcggaagaggggatagctctcagtccccaccctcgtggggttgcctccccctcctgcgatgggggtcctaagaacccgggggggaagagggactggctctcagtccctgcctcgcgggggtgcctccccccctgcgatgggggtactcacagccaggggcggaagaggggatagctctcagtccccactctcgtggggggtgcctccccctcctgcgatgggggtccccagagncagggggggaagagggactggctctcagtaatcccacgtaaggtacctgccgtcggaagatttgaactttctacttggacaactaacacccacagtcctccaggtgggtcctaaggatcttaggatcaacgatngggggtcctaagccgggggggaagagggtctggctctcagtccccacctcgcggggggtgcctccccctcctgcgatgggggtccccagagccagggggggaagagggactggctctcagtccctgcctcgcgggggtncctccgcccccagcgatgggggtcctaagagcaaaggggggaagaggggctcgctctagtccccgngtcgtgaggggtgcctcctcccctgngatgagggtgcaaagagccaggggaggaaagggggaggttcgcagtccccgcctcgcgggnnttgcctcccccactgcgatagtggtcccaagagccaggcggggaagaggggttgctctgagtccccgcctcgcggggggtgcctccccccactgcgatgggagtcccaagagccaggggggaagaggggatggatctcagccatcacaaaatggggggcctttatattcaggttttacccaagaatcagcttatttgcttcttgtactagcagggcagttgctgccaaggccctctaataggggggccatcctttagaaacctgtctagttgtttagagacgtaggctaccggcctcagccagggccccacagtttgggttaaaagtccagctgccatcttttctctctctgacgcatacaatggaaaaggctttgtcagatcgggtagccccagggctggggctgccagaagtttttcctttaactaatgaaagacttgctgttgtcgggatccccatttcaaagtttccgggtccccgccccctttgtgacctcatacaaaggcttggctaatactgcaangtttgggatccacagtctacnaaaccccacagctcctaagaattctctcacctgccttctgcccttaagctccggtagattgcaaataacctgctttctttctgttcccgagctgcgttcggacccatgtcttattgtaaatcccacgcaaggtacctgccgtcggaagatttgagctttcttcttgaacacctcatacccacagtcctccaggcgccagtgggatcaagagagggcaacattgcaactctccatgctcctgcaatatccatggctattctgtagacagaaagacaacaggtacaaagccctaaggattataaaggtatgctgcttaccatcatcttagtgaccaaggcagcgaagctgtttctgtaccttggaacagtcttccctgacaagccagagaacagtgataaagccaccagccttgggatcaggactgaaaaggcaagagtgatggagatttctcctgcgctaagccaagagaaggtttcagcacttcagacagctcccaccgaagtagccgcgctcccagctgcttgcagatgttgaaaaggaaagcctcggtttgtcttgaggttgtcagcaggtgcaagacacgtaataaaatgcaatgtgttcctaaaaaannnana

SEQ ID NO: 66483 - DNA, 661 bp, Homo sapiens
gcttatttgcttcttgtactagcagggcagttgctgccaaagccctcaaatagggaggccgtcctttagcaaccctgtctagttgtttagagacgtaggctaccggcctcagccagggccccacagtttgggttaaaagtccagctgccatcttttctctctctgacgcatacaatggaaaaggctttgtcagatcgggtagccccagggctggggctgccagaagattttcttgtaactcatgaaaaacttgctgttgttgggatccccatttcaaaagttccgggtccccgacccctttgtgacctcatacaaaggcttggctaatactgcaaagtttgggatccacagtctacaaaaccccacagctcctaagaattctctcacctgccttctgcccttaagctccggtagattgcaaataacctgctttctttctgttcccgagctgcgttcggacccgtctgatcgtaaatcccatgtaaggtacctgccgtcggaagatttgaacgttctacttggacacctaaaacccacagtcctccaggtgggtcctaaggatcttaggagcaacgatggggggtcctaagccagggggggaagagggtctggctctcagtccccgcctcgcggggggtgcctcccccctctgcgatggggg

SEQ ID NO: 66484 - DNA, 515 bp, Homo sapiens
tcagaggcagagtctcactatgtcaaccatgctggagtgcagtggcacaatcagctcactgcaaccttgaactcctgtcttcgagagatcctcccagctctgcttaccaaagtgctgggattacaggcatgagccatacaccagcccaaagacaagatttgactaatgaatgatacaggtaatgaacatgagggattcagatggaggagagcttacttcttcctaggtagctcagaaaatactgcagagaaaagatgagaatggaagtggacagttgaggcagagttgaatttcaatggcagcaagggtatatttaaagcaatagaagataaattcacaaaggccccatagtcaagacagcaaagggcctgttgaaaatactttacccagcctcttttccaatcagaaaagagggctttctatctcctattccttggggtcttattttctttcctctgatctgataaactaatccttcctgaagtgcaaatggattgatgagtagccctttctga

SEQ ID NO: 66485 - DNA, 1050 bp, Homo sapiens
caaatggcagttctcgagaatcgacgaggaacttaaatctggactcagggtttcagtgcggtctccgactcccaccaccccgcccctccgcctgtctcgccgccaggtgtgacctccacgcgaaggaatcttcttcggatgggtgcaccttgccaacaggtgtggcacctggaggactaggaggcgcctccagactaagggcgctcagtgcggcgttcttgttgcagatgattctggaaggccggtaggtgtcgggcgacatttgaccttcttcaggtgcttagaactaagtgtctggaaacatgatcctttcgcgtaagtttctttctgaaagccaccaatcttgactgtaagctgtatttgagagatcttttggctgagtttacttatgacctaacggttagtcaccaactgaggcagggcacaggatgaccaaaaaaaaagtgtcagtttttacacaactctggcctgcaagagcctacgtgcttcataaataaaaataaacatacgagcaaggaaggtgcagagccccggaaatatttttttctcacatttttgaaataccatgcacatatatgtggctatttaagtataactactagtgttcactcttactcatttctacaacttttttttttccatttaaaaatcgattattgttacggtttaaacctcgggttggtctaaagtgacattgttggtctcattacagcctctagtggacagttaacatcagtttcctgaaaaggctctgactggttttgttttcgttgacaagctttgtcaaggtgaaggttagtacgtaagagcataaccgggtaaaatgtcccctcacccctatcctcacccccgcccccaacaccctgcttggcaaagacgacttcagaaaggagcagaagcttgttggctttgtatagaaaagacgtatgctttgtgctgcaggtattattattactggactgtgaataaacagaaagcttctgctatcatttcagtttcagacagctttcataaaaactaaattcatctcaaatatttttataacagaaa

SEQ ID NO: 66486 - DNA, 987 bp, Homo sapiens
caaatggcagttctcgagaatcgacgaggaacttaaatctggactcagggtttcagtgcggtctccgactcccaccaccccgcccctccgcctgtctcgccgccaggtgtgacctccacgcgaaggaatcttcttcggatgggtgcaccttgccaacaggtgtggcacctggaggactaggaggcgcctccagactaagggcgctcagtgcggcgttcttgttgcagatgattctggaaggccggtaggtgtcgggcgacatttgaccttcttcaggtgcttagaactaagtgtctggaaacatgatcctttcgcgtaagtttctttctgaaagccaccaatcttgactgtaagctgtatttgagagatcttttggctgagtttacttatgacctaacggttagtcaccaactgaggcagggcacaggatgaccaaaaaaaaagtgtcagtttttacacaactctggcctgcaagagcctacgtgcttcataaataaaaataaacatacgagcaaggaaggtgcagagccccggaaatatttttttctcacatttttgaaataccatgcacatatatgtggctatttaagtataactactagtgttcactcttactcatttctacaacttttttttttccatttaaaaatcgattattgttacggtttaaacctcgggttggtctaaagtgacattgttggtctcattacagcctctagtggacagttaacatcagtttcctgaaaaggctctgactggttttgttttcgttgacaagctttgtcaaggtgaaggttagtacgtaagagcataaccgggtaaaatgtcccctcacccctatcctcacccccgcccccaacaccctgcttggcaaagacgacttcagaaaggagcagaagcttgttggctttgtatagaaaagacgtatgctttgtgctgcaggtattattattactggactgtgaataaacagaaagcttctgctat

SEQ ID NO: 66487 - DNA, 762 bp, Homo sapiens
aacaaacgaacaaacaaacaaacaaacatcatgggagccattggaaggtgttcccattggaagatgctcccatatgccacagggggccgatatctgatttttgcttcattttcaacccgttcatggtgcaaatgaggaaaccagaccaagaagggagtgactttccccagatcacagcaccagtgcccagcctgtccgacttgtattccgggctgtgtctcgcccctgtgagaagtttctttcctcacagttgtaaaggccagaggtccaaaatccaggggtcagcaggaccctgcagtctctgaaggcccttttccttcctaatccttccatctctaagtctgtgaggcagctaacaggttttgtagtattgtctcacattagcgtggtgatgtccccaggaagtagacgttagaaccatccccattgtgcaggtcaggagactggggaggccctgaaaggcacaatggctagtttggggtcacagaactggcaagaggcaggagcttggtgacccagatggcttcccctctctgagcctcaggggctgggagcatgagaacacactggttggctgtcccagctcccagggtggctgtgagtacctggaagtgccccttgtctcccctcacacatctgccatcactctccccatttccttaacccccagcactgctgccacttgatttttacgaacatctgaatatgacgaacatacagatttttacgaacatctgaatatgacgaagtagcaaaggtgga

SEQ ID NO: 66488 - DNA, 354 bp, Homo sapiens
gacaatgttatggactgaattgtttcccctaaaaatttatgtgttgaagacttcacacctgagtaccttagaatgtgaccttacttggtgatagggtgtttacggaggtaatcaagctcaagtaaggttataaggtggaatttaatcctgcgtgacaaatttccttataaaaagggtgaatttcaacacagaaacatgcatatagggaaggtgatatgaaattgcagggaggacaccatctacaagcctaggagacaggcctggaacagacaaaagaccctcccctcacagccttcagaaggaaccaatcttgtcaacatcttgatttcagatagctagcctccagaactgtga

SEQ ID NO: 66489 - DNA, 465 bp, Homo sapiens
ttttatcttgcaagatatattaaagcctcctagtacactgaagattcttggaaaattattgatcctctctgagaaagaaagagctctctccactcttagaagttctgtaagatcccaccaaaaaatatcaccttctttgtgaagcctcttactttccttccgacccattgtcaagatcccactaaaatatcaattcctctgggaagcctcccaaaatgtcctaggctgctctccttctgaggtttcaaaagcatttcctcgatcactctgtcatgattatttgactattattttacatcccccatcagattgtggatcacctaaggctagggccaggcttgcttcactgaagactgctctacggcctaggacagtaatcagagaaaatgcactgtaaaatgtgttaggtaatctattagtctgtcgtcatgctgctaataaaaagacatacctgaaactgtgtaa

SEQ ID NO: 66490 - DNA, 2650 bp, Homo sapiens
ggcgcggactctgcggttcgcttgactgacggcgcagcctccgggcctagccacagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttatggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaa

SEQ ID NO: 66491 - DNA, 2134 bp, Homo sapiens
agtggattgtgaaatgcgtctactgtaataatatgcaatgtcttgattacctgctgaaataaggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttatggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaa

SEQ ID NO: 66492 - DNA, 3106 bp, Homo sapiens
ggcgcggactctgcggttcgcttgactgacggcgcagcctccgggcctagccacagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttatggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaatagctttttaatagatgtaatgatcatatggtgcgtcacctgtgccaaatattcttcaatgaaattatataatgtaactttggacctcagtttttctttagaaatgggtgggagaatgaaaatgcaaatcaggaaaccacattaaagtcaaggaaataaaataatttgaccagaggataaaggacatgagagagtattttaaaactaaagaaaaaattagctgccagaagcaactgaggaccttttttgaaacttgagtagcagtgtaattgagctgagtttgaaagtcctgattcagagagagactgagggttgacaaataaactgtatcaactaaactttgatataaaccagaatgtgctaaatgttttttatgtaaaattgtatatttgttagccattctgtgtctgcagtattgtcataaaattgtcctttcattcttttg

SEQ ID NO: 66493 - DNA, 2136 bp, Homo sapiens
ggcgcggactctgcggttcgcttgactgacggcgcagcctccgggcctagccacagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagaacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaa

SEQ ID NO: 66494 - DNA, 1376 bp, Homo sapiens
ttcgagcggccgcccgggcaggtacgcgcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaa

SEQ ID NO: 66495 - DNA, 2696 bp, Homo sapiens
ggcgcggactctgcggttcgcttgactgacggcgcagcctccgggcctagccacagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttatggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaaaaaaaagtcgacgcggccgcgaatttaggtagtagctagtagtag

SEQ ID NO: 66496 - DNA, 2845 bp, Homo sapiens
ggcgcggactctgcggttcgcttgactgacggcgcagcctccgggcctagccacagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttatggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaataaaaaaaaaaaaaaaaaaaaaaagggggggggcgaaaaaatccgaggggccattagggtacagttttttgaaggggcccaaggaggataaaagaagaggggggttaaaggggaggaaaggcgggattggagaccatctggggaaaggaacccaaatagaggaaaatggtaggaacttgtgattgtataaaaaaa

SEQ ID NO: 66497 - DNA, 1812 bp, Homo sapiens
  misc_feature (277)..(277): n is a, c, g, or t
  misc_feature (312)..(312): n is a, c, g, or t
  misc_feature (331)..(331): n is a, c, g, or t
  misc_feature (333)..(334): n is a, c, g, or t
  misc_feature (343)..(343): n is a, c, g, or t
  misc_feature (377)..(377): n is a, c, g, or t
  misc_feature (389)..(389): n is a, c, g, or t
attcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatngttgtaatgaatgtggaaaagcctttacgttcaantcacagctcattgtacatnanngagtgcacnctggagtaaaaccctatggatgcagtcaatgtgnaaaaacctttantttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaacagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaacataagattcacaaagaggaaacttcatgaaccagatgaatatagaatagacttctttgaaattcatagtttacagaattttaatgagagaaattattgagctaatgaatggcagaattaacaaaattacaaacattttatgtatcggaaggatataccttggagggaccatgctatgagggaaagtgtaaatctagaaatgagaaacccctagggaaaaaatatatataggagtgaacatcttatgaatgtaccaaataaaccacagctggactgttaacctcaccttagaagcttcattc

SEQ ID NO: 66498 - DNA, 370 bp, Homo sapiens
actttttagtttacaaaggtgtttgccaaattagtgtaaccacagggtgtgttaacacatgcagagattagcagcatcaggaccacgctgcccctcctgatgccagggaaagagatgtgtttccagagcctgatgagagctgcaacaatggaaaggggcccttctgccagcaactgttatcttaaaggcatatggctaagtcagaatatcacaaaagcagggaggaagcagaaatctcctgtcatcgcctcctgctggccaaactcagctgaagccaccaactaaaacaaagttctgtatgctgaattcacataaaactcttaatgtcacacttagcagattcagttgattgcttacaatatttagcttc

SEQ ID NO: 66499 - DNA, 481 bp, Homo sapiens
tggttatcaattgttaaacggcccaggatctctcagagctcatccaggtatgtgcatagagccctgaaatgctgatattgccttagggggttatttgttttttatagccccacaggccatagctggtgcatttgcctgagcttcctcatcctttgtacatatacccagggaggagaaggtgaatagataagatctttcagcctgcagatttccagtaataaaagcaaatgctttctgttgagacccagctgagactggaggtggtgaataagggctgtatgtgtaagcactgtaggcttctggccagtaaagaatccagacacagcctgcaccctcctggcctcctggaactctaagagcacagaaggacagggtacagacctatggagtatgacacttattccagggactttgacctgctacatttacaggtcatgacagctttgatgctgcctctggggaagggccaccattcaacttg

SEQ ID NO: 66500 - DNA, 363 bp, Homo sapiens
agcatttgtataaaaatatttacttagaattataatattttctctataccttcaagttgatgaacttgactttctgttgatttttggtcttataataaattatgtcaattttgagataccagttaatacaacaaggaatttacattttagaattacttgtttatataactgaaataatgaatggaaaggagatttcagttaatttctgaccatcagcttcagtgttaatattacatgaagcatcagtttcagtgttcttattacatgttcctaaacagaataatattcctgttttatggatggagaaattgaggcattatttatagcaggaattttttgttttaccaccaaggtaattgcaga

SEQ ID NO: 66501 - DNA, 327 bp, Homo sapiens
gtatgtggccatcccagctgtcccacgcatttcagcccaggaggcctggagaacccaggagtttccaagctgtgctgccacccgagctctggatccacctggctgtggtggcctgtggcaatcggctggaggagacgctggtcatgctcaaatcagctgtgctttttagccacaggaagatccaattccacatcttcactgaagactctctgaagcccgagtttgataagcagttacgccagtggcctgactcatatacaaagaagtttgagcacagaatctaccccatcacattttctgttggaaaccctcaggagtggaagaaat

SEQ ID NO: 66502 - DNA, 534 bp, Homo sapiens
aacccccttgtgataaccaacctaaatttaattaacttccataggtcccaccttcaaataccagcacatgaggggttaggatttcaacacaggaatttcaggaggacacattcagcccataacaccaaccagttttatttttaccatcctctggaaacaaaataaggaacttgtaacatgttcttcccgggcattagatgatctgaatgtgtcaccctcaaactcatatgttgaaacttgatccccaatgtgacagtatttttaagaggtggggctcttaggcatgattaggtcatgagggtggagcaatgggattagtcctcttatcaaggggcttcatgcagtgtcctcccctttttcttttttgcccttctgctatgtgaggacacggtttccctgtgaggatgcagcaagaaagcaccatcttggaagcagagatccttcaccaggcacagattctgctggcaccgagatcttggacttcccagcccccaaactatgagaaataaatttcttgtatttctaaagtaaaca

SEQ ID NO: 66503 - DNA, 380 bp, Homo sapiens
gaagaaatgagaagcaaagaaaaaccgtgaggcatgaacatttcatggcaatcacgatgtcctggtttgtgagataatgggatagaggagtagaaaacaaggagaaagatgagaaggtacaaagtggttcaagtcaaacagctcaactgaacttttcttaatagaatatttaaaaagtggtacattaaaaaacttcccccagttcacatcaaaaattctctcttcaggactaagttgggtagagactgttcaatgtgcctagatatcttcagaacttatatattttctgttttctacgtatgttgaagggcagtgccaaatgatgtgtaattatctaggttgtaaaaataaaacatactcccccttcccttgaggataaa

SEQ ID NO: 66504 - DNA, 445 bp, Homo sapiens
taattttagggactaggttttgctatgttgcccaggctggccttaaactcctggcctcaaggtgatccttctgccttggcctcccgagtagctgggactagaggtgtgcaccgtcacacccagcttcaagtctcttttaattattataaagttctggccatgcacagtggctcgcaactgtaatctcagcactttcggaagccaaggcggtcagatcacctgaggtcaggagttcgagaccagtctggccaacatggagaaactccgtctctactaaaaatacaagaattagctgggcgtggtggcacacgcctgtagtcccagctactcgggaggctgaggcaagagaattgcttgaacctgggaggcagaggttgcagtgaaccaagatcaagccatttgcactccagcctgggcaacagagtgagactctgtctcaaaaaaa

SEQ ID NO: 66505 - DNA, 357 bp, Homo sapiens
taattttagggactaggttttgctatgttgcccaggctggccttaaactcctggcctcaaggtgatccttctgccttggcctcccgagtagctgggactagaggtgtgcaccgtcacacccagcttcaagtctcttttaattattataaagttctggccatgcacagtggctcgcaactgtaatctcagcactttcggaagccaaggcggtcagatcacctgaggtcaggagttcgagaccagtctggccaacatggagaaactccgtctctactaaaaatacaagaattagctgggcgtggtggcacacctttacaaaattaataattccaatcatcctatagttgatcagtgttc

SEQ ID NO: 66506 - DNA, 299 bp, Homo sapiens
taattttagggactaggttttgctatgttgcccaggctggccttaaactcctggcctcaaggtgatccttctgccttggcctcccgagtagctgggactagaggtgtgcaccgtcacacccagcttcaagtctcttttaattattataaagttctggccatgcacagtggctcgcaactgtaatctcagcactttcggaagccaaggcggtcagatcacctgaggtcaggagttcaagcgattctcccacctcagcctgccaagtagctgggattacaggcatgtgccactgtgcccag

SEQ ID NO: 66507 - DNA, 168 bp, Homo sapiens
tatgaatgcaacaaatgtgggaaattctttaggtattgcttcacactgaatagacatcagagagttcactctggagagaggccttatgaatgcagtgaatgtggcaaattctttgtggacagctgtacactgaagagtcatcagagagttcacactggagaaagacct

SEQ ID NO: 66508 - DNA, 441 bp, Homo sapiens
tgaaaccatgagattcttccctagtgttccaatctcctttgatttttcaggcctatttcagctctcattttcatatcccagctttgcctttacactcgatattttaaagagcttcagagttgaccaaaattgtgtcctagtgcatggagaagttattccattctctccaaattgttatcctggatgattggatttaacaacctctaggaggatttgtggaggttttagtttgatttccctgtgatcattgatggtatttttattttcatttgctaagaagctttctgcagtacagggaatagctaatcatgccattcctatctttggctcatcttaacttccttcttactaaacatccacctttaaatactatgatctaagaatcataattattcctatacaatgtgctaaccaaatcacagcacaagtgatagatgtgat

SEQ ID NO: 66509 - DNA, 693 bp, Homo sapiens
ggcttcacactgggaacacctggccccatgagcactctccgagccaggctgctcccgcagatggcgggggtcagaggaggaggaggacggcagcttgctcctggtctgcccgctgcttcctcgccaggacccaagcagccctggcttcatgggcagggagaggaggaaggtgtattgcctgtttcacctggcccacgtttcccacaagagggtaaatgatggctgtcttcccagcctggcccaccaatgaatgtttaactcagaatgcaggcttgaaatctgaataggtcagacctgtggaactgccaatggcttacagaagtggcaattccatatggttcacacctaatacaaatattgatactacatggcctacatgttccaagatctgagtctttgtgataaagttgtttgcatgctctgaggacaaactgctggttgaatgttctcaggtgacaaatggtgtcttctttgggctactgttaccccatccttctggggtcctcaggtaagtcctcctgccgtggaacggtctgtttatatgtgaatgccctgccttcttagggctctgaatctcagttgaaattggggctatgtcacaaagcattaaccggctgtgtctgtattgtctgtttatattacacaccaaatagaaattattctttaagaaccaaaaaaatgcttaaaaacgaa

SEQ ID NO: 66510 - DNA, 474 bp, Homo sapiens
ctctgccatgtgaggtcacagtgttcctccctcctgaggatgcagtgttcatgaaagcaaacactgggccctcaccaggcaacaaacctgctggtgccttcatcttggacttcccagccttcggaactatggagcccgcactctccagttcatcaccaccccagcatccctactcttgcatctaacagtttccgctattttgcaccacctgcctggcccttatgggcaactcaaggaagaaaggaaagaagagatagaggaaaaatggattcaacagatgaaagtgttctttctgactactgctgtgtttacaaacattttaatcatcaaaacatgctttatttgatagaaagatcaaatctgcctttgtaaaacaagagactattttaatcattaagacaacacacatgtttgatttggaggcgtgttctcattcaaaaccttgcaaaatataatttcttcttgtctgggaga

SEQ ID NO: 66511 - DNA, 746 bp, Homo sapiens
ttctagctaatgatacggattacaggcgtgagccaccacacccggccatgaattaatatttatgaagtatttgaaacactgtctagcacaaagtaaggactcaacgagttcagcttttattattttttaaaaagtattttctgtattgtagccccttgatctagatgagtaagttgagcttaaacaggttaagtcaaagactgcaatctggtcactcactgttggcttgcctggtttaaacaaatgtttaaatggattgcaaccatttggaacctgagaggtttcatatgaatatgaagaattctggcttatttgagtaacaggataatctcttagcactgggccagcattcctgcaaggcacccattggctcttgctgaccagtggcttctcgttgcagatggagcccgcactctccagttcatcaccaccccagcatccctactcttgcatctaacagtttccgctattttgcaccacctgcctggcccttatgggcaactcaaggaagaaaggaaagaagagatagaggaaaaatggattcaacagatgaaagtgttctttctgactactgctgtgtttacaaacattttaatcatcaaaacatgctttatttgatagaaagatcaaatctgcctttgtaaaacaagagactattttaatcattaagacaacacacatgtttgatttggaggcgtgttctcattcaaaaccttgcaaaatataatttcttcttgtctgggaga

SEQ ID NO: 66512 - DNA, 291 bp, Homo sapiens
tgctctagccttctggagggcagaaatctgggtctctggctggttataaggcttttattctcatgtttatctcctggatgatgaataaaaggatcagtgacctcaggagatactccctagaagggatgtggctattccctaatggaattaccaaataccagcatagctggctaaaccagtttgaaaactacttttgtacaactttaagtttacaattattttaagaatttagatagtactgtgcaaataaatggagagagcccaaggcagaaaaaaactacatactctatt

SEQ ID NO: 66513 - DNA, 398 bp, Homo sapiens
taagatctcccccaaatgatgcctgtaaaggacatctcatttctaacacctttctgggatgttactgtgtggagcactgctcagagacgtagcacaagatggtcggtttaccaactgcatttatttattgaccaaatcatttctttatgttcagaatatttttaaaggaaaacaggagaagatttgtgaaaccaaattatatccactttaagtacacttagaggctgacactttctcttaagaattctcgaacagtgaaaccgacatttttagccaggtccctcagcataaaacacaaacagaacattttctagggcgggaaaattcaagttactccacacacataggtgaagatgatgtttatgctgtttggtggcaaacctctccagctggacgtg

SEQ ID NO: 66514 - DNA, 313 bp, Homo sapiens
ggcaacaagccaagtagcaaagatataagcaacaatcaaatggagcctgaaatatgataagagcatacatgcactttaacaataattttgatactggaatgattatttcagaagcaatattttttctgaaaagcattggtcttctgtacagaaaaataaaaaagtgagctgccactcatagtgaattaagagctgtgggctgaaagggtctcttttatagccagtttgaaatttttcatataataaaaacagtatgtaaatattatatatatatacacacatacatatatatgcatatatgtacatatttctg

SEQ ID NO: 66515 - DNA, 1970 bp, Homo sapiens
  misc_feature (649)..(649): n is a, c, g, or t
  misc_feature (843)..(843): n is a, c, g, or t
  misc_feature (845)..(845): n is a, c, g, or t
  misc_feature (1121)..(1121): n is a, c, g, or t
  misc_feature (1137)..(1137): n is a, c, g, or t
  misc_feature (1294)..(1294): n is a, c, g, or t
  misc_feature (1394)..(1394): n is a, c, g, or t
gtcatttcagagatacctatccttgaactataccctggtaagagtgggcatctattctttatgacaggagtcactatcaatataatttaggcctgcagagagatgttttctgagagaaaccaataggactattaaccagaagctaaagacaggtatcactatcaccagatgttatctatggaagacacatgtagagactctgcctgggagaaaatgctgattgaaaattctctctgtccatgtgtgagtgattttatacatttgactccctcttatgatagatttttcttagaagaaagaatagaccccaaaagattaatatgaagactgaggaggcttcacgagcatgtcaggtgatttatggcaggcttgaattggagcttaatcagagtgttaccagtagagggtgtccaggttcttggcatcttgaacaaagaattggacaaaacgcacaaacgaagcaaggaagaaatgaagggattgaaaattaaagtacactccacaatgtgggagcaagcctgagcataggggctcaagggccccgttacagaatttgtaggggtttaaataccttctatgggtttccattggttacttggtatatgccctatgtaaaagagaggatgaagtaaagttacttatatttggngtatgccctatggagaggctatttcccgtcatagctgaagtgtgaatcggctttatgttcccttcccccagaccctattttcctgcctcattttctctctgagagacgtgatccccataaatctttataagaggcagagggacccacagtctttcttctataactgcttcatgctggcttgagatgtagctccnancgactgagtatcacagtactcaccctgctctgtctagtggggacagggtttccttgatggtcaggggtggtgtctttcacctggaactggctggaacccttgtcacatgatcatctgaagcttgatggtctctaggcaagaggaaatgaatttcgttaaaagatttaatgggaacttcaaggagtggatacctgtgctgtcaagaatgtttgttatagagatttgtatgagaaaaacaaaacctggtttgtgttgtgttctaggatctatgtgttnccttaaagtcttagcncaagcaactccattatagtttggtttggtctgttggagcctagtgcatgagctcagtccaaaacaatggccttccataactttgttttaaaaaatccccctttttggtcaggttctcacttaggtgagagggtaaccaaaacttagggccttaatancactctcagttaccatcattttgggtttcagtcttagcacatcattcataggttatggtgtcctcatggttgctcatttctttcagctcttgttatttcnattgaagagagaccgtatgacactctagagatggctgcatgcaaacattcaaaacctttgagagaatacagcatgccaggaagactattattacgactaatgggaagataataccaagaatttggagtatactccttacccaaggtccccataaactgaacttcctaaaatcaaatagatcaaagaatgagctagataaacagtttactacttaactaagcagtccctttgcaaattctctaccactgaatttctataatcttcatttgatgtatttttccataggccacaagtattagcagctgcacagataattttctgttcagcaaattctattataactttcacaagacaatttaaagtctttgtgtaactgtagcctttacagtaaaatttgagcctatcatgaggtgtacatttctaatcattgctttttcactttaaaccaaggaaaaaggacctaacaaatgatgctcttctggaagagtgaaggcctactggcaatgttctctttaacccatgatgtgggctaagaggagtgaaccaataaataaaataataaaataatccaaattg

SEQ ID NO: 66516 - DNA, 703 bp, Homo sapiens
aagctagctgttaccagtccaggtaagggtaccgtagcttgggctacgcagccatgtgctattttgggggtcggaatcagacacacctgcattaaattcccagctctaagctaataaactcaggcaattttctgaggggagttaagaatatatgttgacaagtaacacaatgaaatgtaagccctgcagagcatctcgctgccttgcctactaaccctacgcacctagaactttcgtctgaaacagagtatatatttaaatccctttgttcaagtgtgcaagtaaactgagtactgcagtctttccacttgtttcccacttcttcccagtcttgactgagaagactcctaagattcagggaatctgtggaatacaaatattgtggagacaaagatggaaaacatccagcctaagaacacaggacaggacaggcgcggtggctcaagtctgtaatcccggcacttcgggaggccgaggtgggcggatcacgaggtcaggagttcgagacaagcctaaccaacacaatgaaaccctgtctctactaaaaatacaaaaattagtcaggtgtggtggcacgtgtctgtaatcccagctactcaggaggctgagacaggcgaatcgcttgaacccgggaggcagaggttgcactgagccgagatcatgccactgcactccagcctaggggacagagtgagactgtctc

SEQ ID NO: 66517 - DNA, 930 bp, Homo sapiens
cgtgaggttttttcagtgggattatttgtgtccctgtggctcttcagggagcttgcagaattctagctaaagataagaagggcatcgcttcaaatgggaggccaatcaatgcagcattaggaaggcttcattcagctcagcaccaccttggtgaagatcccggtgttacacatccaatcgttcacctccttccaagactatgacattccaggaaaccttcactgctaagaggaactaagatctagagtatctcctcgaggaagtacaactggattctccctccttggttcttccctggaccaaggacagaagaatcattcaacacagaggctattgacaaaaggggcatatttggtgcaaacaggggtaattaataagaagtccagtggctcacacctgcgatcccagcactttgggaggctgagatgggcagattgctcgagcccaggaattcaagaccaacctgggcaacatggcaaaaccccatctctacaaaaatacaaaaattgaaccagatgtgatggttcatgcctgtagtcccagctactctggaggctgatgtgggaggatcgcttgagcctaggaagtcaaggctgcagtgagtcatgattgctccgctccactgcactctggccttgatgatagagtgagaaccagtctcaaaaaaaaaaaggtcattttctaagcatttgttgattcaatactgcccactatgtacactgacaattagacataatttaatttcagctcatggtatgaatggagacaaaatgaaatcattttaatgcacattaaggcaatatagtgcccttaaataaaaagttgaagttcataagggaccatcattaagatttaactttgtaacaaatattttgtttttgtttgttttatttttagatttgcataataaaacattcatattcttaccca

SEQ ID NO: 66518 - DNA, 416 bp, Homo sapiens
ggagcttcttcccaccagggtgtgaagtagttttgacagcaggtgtggtgtgtcagcctgaaacctgaacagggcatcaccttttacctggtgccatcacagagtgctccagatttgggtaggaagaggatcccgtcacatccaggcatctcttggcagaggaaagggagctggtcagggagttttgaaaacaaaaattgtactataaaatgttttatttggggagctgtgctctggcagcatcctgatctgaaataattcctagccttttgtgtggttggtggtggctgatccatggaatcctgctgtgtcgctcagctgctgttaaaatattggatcaaagaaatgactcaggaggaaaagtgtcaagtaaaagttaatcatttcatccttgctgaaagatagaatttgagttg

SEQ ID NO: 66519 - DNA, 344 bp, Homo sapiens
gtatgtatgtctgtaggtatttctatacttaaccatctgtgtcccaattaagctaaacatgattcattctgatgccaacccccatccatcatgccatggatcgctctagacttcttcccttgtaacctcccactcaaacagtgagaaacctttgcccagtatgttttgagtaacctcactggagttgcagtcccactagatgaatgccaacccatttgttcatttaaaaggactttggaaccatagagcaatggctgggctgggtctgccacgctcatctcactgaaacatttgccatgaaggcactgccaagaaactctaggaccacagggtcctggtgctgc

SEQ ID NO: 66520 - DNA, 423 bp, Homo sapiens
ctatttcattaataccgctattattccactttgatgagtgctttgagattttcagtttttggctattataagtaatgcttcagtaagcatctttgtgtacataaacatgtttccataggatgtgtacctaggagtggaattgctcagttataaggtacgcacacctttaaaattttatattcccacctctgcttccatgatgtatgagagtgcttgtttatcaacacttggtgtggccagattttaattttagccaatatgatgtttatatagtagacgtttgtttgtgtgtgtgtgtgtgcgttttctctctctcttctgagatggagtcatgctctgtcacccaggctggagttcagtgagccaaaatggtgtcactgcactccagcctgggcaacagagtgagactgtctcaaaaaaaaa

SEQ ID NO: 66521 - DNA, 430 bp, Homo sapiens
tctttttaaatatttttactacacaaaaacttctggtagctgaaaaccactgtaaattatttttttgacaagcaacatactaatagatttttttttccagttttctaatccctcttcttaaattatcttgagattcttctggttacaaaataggaaaactataaaggaaaaggccagtagcccaacagttgaagaaccaccatatcatcagctgcttattttctatatttttatgttctttggggagcaaaaatagaactggcgtgttttgtaaggtattatccagacttaaaaattaaaagaacacatctatttttaggtcatggtagtcagaggcttgttgtcacattaggtgatatcctccagtcttttgtattagaggtgacgttttggctatccatgtgaatggatttgcccaaatcaggcctaa

SEQ ID NO: 66522 - DNA, 1902 bp, Homo sapiens
  misc_feature (782)..(782): n is a, c, g, or t
ttttttgtggatttggttgtagttgttaaaagttctctacgttttggatggattgccttaattgtatttatacaaatgagtttggtttatattacgctacttatttagaaggacactctgctcacaaattatactagtttggtagtttcataaactagcttgaatcaaaataaaatggtgctaaaatggatgttattttcaactgtgcactcagtaattgcaaatagttgtactatatacctgggggtgaacacaaaggaagtagttgcatcatctctgtataaaacacagatttatctttcgtgtagttgtgcattacgtagaatatggtaaggcaacatctgagttgtagaagtgctactggagtaacagaggtgaggaatcggttctgctcaagggagaggactggagaagagacctagaggggagagtggaccttgaagaactgattggatttctcctgttggggaatgtgaatcataaagctgaggtagggggaacaagtatgaggctggcaagtagtcggtttggcaggagcacagagtgcctgcagggagggccatgggagatcaagctgggaatgtagaaaggaattttaacttgataaattttgactaggtaacaggttcttttatcaaggagtgacattttatgtcacaaaaatttttaaaccatttctgtctcttggaaaacccaaaggtagcagtggcatgtgaaaaattcttgttttaaaagattcaaacaataaagaaacatgtagaatattttgtgtccgtacattntatgtttaggagttgaatattaatttgtaattaatagaatggagaaaagcaatcagttaattagaattcactttataggaatgaaatctaggcttaaagtgtgagaataatctgtcttgctttgttgaaagtgaccttggtattcgaagacagagctgctcactactgtcagtaagacgtatatcttaaattgattaaggctaggtaatcagtttgtgaggattcattcttaacgcttgtgccattggcaggcatattttaggtgctgtctcttgggccataaattagtgacactgagtgctgtggatttacccaaataacctctttaatatttgctactgttaggtgtaattagaagatacatgaaagaggcagggtgtggtggcttatgcttgtaatcctagcactttgggaggctgaggcaggtggatcaacatggcgaaatcccatctctaccaaaaatacaaaaaattagccaggcgtggtggcacccgctgcacctgtatcagctattcaggaggccaaggtgggaggatcacttgggccctggaggcagagattgcagtaagccaggatctcaggatcgtgccactgcactccagccttggagacagagagagactccatctcggggtggggggaaaaaaaagagaaaaagtgagagagcctggacaacataacaagagcctgtctctacaaaaataaaattaaaaaaaaattagccaggtgtgatgccacatgcctgtagtcctagctacttgcaagcctaaggtgggaggatccattgagcccaggagttcaaggctgcagtgagctgtgatgttgccgctacactccaggtgacagagcaagaccctaagaccttatctcttaaaaaaaaaaaaaaaaaagacgtgaaagttcagtaaatgtttgcagagatgaacgctggtatttaaagaagtagaagggattttaaagcaattactgcatttcagctaaaatccgaagaccttatcatggtctcataggtccaacattatctggactttacccatctaacctcaggtcctaccttatctaccacttcactgtatcttggctacgtaggcttcctttttgccatgccaaacttatcctt

SEQ ID NO: 66523 - DNA, 601 bp, Homo sapiens
cacagcctcaacaccagccaggctgcatgacatgtgtctagaagaaagcctgactttcagcaggtgttcaataagtgtgtgcttctgctcttaaagtctcagcctatttagtccactcaccacacagggcaccctgaggggtgaagttttgggtggagatgacggcatgggaaattatatgtctcatgccttggctgcaggtgtgctggactccagctgagctggacagagagtcacattgtgcaaggcctgctgtcccattgatgtggtcctggactctcagcagtgtaaaaagccatgttcccatttaaaccaccgcgtgtagacatcgtctcatctgcttctgtgttgcaaacattgctccctccttatactttagttgtcagcatcttcattacataggggccagaattggctatctgaatgcaggagtgtttcctgacctgcccagggactgcaggaaccaccatcgcttgcaccacctggggacccacaattgcatctcagagacctgtgtttctcatctgtaaagtggagataataatatgtttccaaaagggcccctgcacggaataaagtggtagaaataaataacctactg

SEQ ID NO: 66524 - DNA, 394 bp, Homo sapiens
tctgggtctccagtctgcccatctgcctgccctacagattttggacttgcacctccataattgcatgagccaactccttaaaataagtctttcttcacatatatacacatatcctgttggctctgtttctctggagaatgctcactgatgcagggatgatcagattggttgtgctattgtggaagtagtagttttcctctagatgctgatcctggcagggcagatccaggttttgtggggcctgaagcttatacaatgtcagggcctgctataagaaaaagcataaagaattatggatatgaaattacaactttgcatgtctgacaactggaagaattttccagactcttttggaatcatgcttttcaaatcttatttcttctttgctactttc

SEQ ID NO: 66525 - DNA, 425 bp, Homo sapiens
gagacggagtcttgctccgtcacccaggctagagtgcagtggtgttaaaaaaaaaaaaaaaaaatccaagacgtttaaacatctattgatatcagggtgagatattacacttgactttattgtattatgactattatactatatattaaagggcccaagtattctttctaggtaaggtatattattaaaaaaaagaaaaaatattgtgccaccagaaatgttagttatgaatctgagtggtgagctttgatgtttgctaccttagttgttaaacaattttgtcttgatatttgagagtttctatggacacatttatttctacttcatcaaaagctaaaacttcggttttttaaaattccagctttttcccttgataaaccttagatctgtttttttcatgctaatgttcttgacaacaacatgaa

SEQ ID NO: 66526 - DNA, 369 bp, Homo sapiens
tatttatactccctggcctccggctctctcagagccaacctctctcttctcctagtgttatgaccctgtcagtcaacattgggctcattagaaaaggccacatgggcataaattatgcctcaagagggaggtcatttatcattggccttcacttgagaagatcaaggctggaaagttcatgtttttattaccaaaattctccttctccaacctttcagaggttcctagagaaaggctttgggaggattggcttgagcatgaagtgaaatagaacaaaggtgaaaagccaggctgggctctgtgaaaggagacagtttgcaaactaccatgtcatatgtggtggtagatttcacactttaaaagagtggc

SEQ ID NO: 66527 - DNA, 1951 bp, Homo sapiens
  misc_feature (1)..(1): n is a, c, g, or t
  misc_feature (547)..(547): n is a, c, g, or t
  misc_feature (1035)..(1035): n is a, c, g, or t
nggaggtgttttctatctactaggagaccgccgttccctggcgccagctgagaccaattattacttcagagagacagttaacaaccacctgaccatcacctgatggtctcccaacactcctggtgtgaggtatgggagccctttcctgccctgctcatacccgactagctaccaagtataacaatagcactcaaagtgatagctaacattttggtcacctttattaaccagattctaccatgacacatgtgttgtataaatgatttcttttcattgccatagcaactccaataggctggtattcattatatctgtttttttaggaaactgaaattgagactcagagaggttaagtaacatccccaaaccagacagctaatacgaaacaaagccatatttgatctctcatcttttaaattaacataaaatatgaaatgaaaaattctgagaaaatataagtgaaaatgggtccagtttagggttaagaaagttatttctaggccaaaatccaagaaggaaactgtaaataaatattttatttttttancttcttatagattttaaaatttttgtgtcaaaataagctaaatgaaatttaaaaagaaataataaatttaagtgattaaatgaagaaaaatggttgatatccttaatacacatttattttaatgagtattatgttttatgtgatcaaatctattagtcttttaaaaaaaaattatgtcctggaagttgtacatagaaaagccttccccaaatattttgttttcattttcatacattgaaatgttcaatccacctggaatttattagacatatagtgtgaggtatggatttagccagctatcacaatattattaataataaacaatttattttatttaaatggctaaatccatccatcctttcattgttctttctcatttattgaatacttatatacatccttgcctgtttctgaacttcctattttattccattgatctgtaccagcaaaatactgtttttattattgtaggttatttatactttacnaaagtgttcttggttagtccctaaaatgtattcctccaaatgaactttttatttatttattgagagggagtctcactctgtcgcccaggctgtagtgcagtggcacaatctcggctcactgcaacctccgcctcctgagttcaagcatttctccagcctcagcctcctgcatagctgggattacaggtgcatgccaccatgcccagctaattttttgtatttctagtagagatgaagtttcaccatgttggccaggctgtctcctgacctcaggtgatccacccacctcagcctcgaaaagttctgggattacaggcatgagccaccacgcctggccaacctccgaatgaactttaaatgactttttaccgaggtctttactccacccctacaaaatgcaagtgggactttcagtgacattacaatatgtttataaattatatggaaatgtcatatctgtaatagtgagtttctccaacttcatatgtggtatgcctctccttttatgcaagcagtagagtcactttttttcatatagttcttagtaatagtctattaaatttatcaccataagtttctttgttgttgttatagaaaatgactttgttagctccattaagattttctgttataatccaagatatttgtaaaaccttatctattatgcatctttgtatgaaatttagacatacttgtgaaatgtaaaaatgtaccaagctttattttttaataaccaaaaagattaaatgtttattttaaattttaacttattttataaataaatatttcctcactttctgatagcttggacctatcaactaggtttgaatagagacttttatttaatgagactgaaatgttattaaccatgaaatttatacccattaaaaatattatccaagagggcctgagggga

SEQ ID NO: 66528 - DNA, 327 bp, Homo sapiens
ttcattgtaaacgttttctgaaatgagtaaatttaagccattggacactaaacatacatgttagcagaacactttgaaaatctgtttcttatcgtttttcccttttgggggtatctttttattaaaaaaattggttgaagttattaacttatttgaactacacatagttataagatcacacatctgtttttcagcaaccttcaattatttgtttatttttttttaacactttcggttcaaatataatgttatcagatagtcagaaatttatgttgaggagcaaggatttaagttggccgtgagaggttatgtacagtatctttttta

SEQ ID NO: 66529 - DNA, 496 bp, Homo sapiens
gaaaagggaactcttatacactgttggtgagaatgtgcatttgtacaacctctatggaaaacattataaagatttctcagagacctaaatatagaactaccattcgatccagcattcccactatggggtatctacctaaaggacaagaaatcactgtatcaaaaagatacctccacctgtatgtttattgcagcattcttcacaaaagcaaagacatggaatcaacctaagtgtccatcagtggatgactggataaagaaaatgtggtatacatacaaaatggaatactattcagccataacaacgaatgaaattatgtcttttgtagcaacatggatggaggtaattatcttaagtgaaacaaatcagccatagaaagacaaataccacgttttcacttataagcgggagctatataatgtatacacatgaacgtagaatgtggaatgatagacaatagagacttggaagggtgagccattggtggagtagatgc

SEQ ID NO: 66530 - DNA, 410 bp, Homo sapiens
cctccctgccaacataccacagcttcttcctgtccacagtcttgaaaatctatcctttcttccaagaactcttctccgactcagagaagcaatctttactcaaccccacttgtaggataaaattcctctccctttccacacagtgaatgtactttgcctaggttgcaaatattgactttatctgtatttatctcacatttattcctccttattctatgctctgtttacccatgtgtattgttagatcatgcccttgaccagcctacctcatggggttgatgtgacaatcaaatcagacaacataggcacagtgctttataatgtaaggattattattaggaggtaggaatttcatctcattttctcagagaagtagctagggcattgtagaaaatagagatttggagtaa

SEQ ID NO: 66531 - DNA, 3932 bp, Homo sapiens
  misc_feature (1585)..(1585): n is a, c, g, or t
ggatcctggagacaactttgccgtgtgacgcgccgggaggactgcagggcccgcggccgagggctcggcgccgcctgtgagcgggcccgcgcggccggctctcccgggcaccaagcttgctccgcgccactgcccgccggcccgcggcgaggacgacctgcccgtctccgccgccggcggcccttcctggcgcgaggcagtgagggcgaggcgctcaggtgcgagcgcggggccccgccgcagcgcccgccgcagcgccgcgccaagccgcgcccggctccgctccggggggctccagcgccttcgcttccgtctcagccaagttgcgtggacccgctctttcgccaccttccccagccgccggccgaaccgccgctcccactgacgctgctttcgcttcacccgaaccggggctgcggggcccccgacgcggaaaggatggggagaaggctgcagatgccgaggcgccccgagacgcccgtgcggcagtgacccgcgacctccgccccgcccggcgcgcccctcgggcccccggggccctcggcgccccttccctgccgcgcgggaacccccgaggcccggccggccccctccccctgcgagccggcggcagccctcccggcgggcgggcgggcggaggcccgggcgggcgcgggcgcgggcgggggcggggcggggcggcgcgcccggagcccggagcccggccctgcgctcggctcgactcggctcgcctcgcggcgggcgccctcgtcgccagcggcgcaccatggacgggctgcccggtcgggcgctgggggccgcctgccttctgctgctggcggccggctggctggggcctgaggcctggggctcacccacgcccccgccgacgcctgccgcgccgccgccacccccgccacccggagccccgggtggctcgcaggacacctgtacgtcgtgcggcggcttccggcggccagaggagctcggccgagtggacggcgacttcctggaggcggtgaagcggcacatcttgagccgcctgcagatgcggggccggcccaacatcacgcacgccgtgcctaaggccgccatggtcacggccctgcgcaagctgcacgcgggcaaggtgcgcgaggacggccgcgtggagatcccgcacctcgacggccacgccagcccgggcgccgacggccaggagcgcgtttccgaaatcatcagcttcgccgagacagatggcctcgcctcctcccgggtccgcctatacttcttcatctccaacgaaggcaaccagaacctgtttgtggtccaggccagcctgtggctttacctgaaactcctgccctacgtcctggagaagggcagccggcggaaggtgcgggtcaaagtgtacttccaggagcagggccacggtgacaggtggaacatggtggagaagagggtggacctcaagcgcagcggctggcataccttcccactcacggaggccatccaggccttgtttgagcggggcgagcggcgactcaacctagacgtgcagtgtgacagctgccaggagctggccgtggtgccggtgttcgtggacccaggcgaagagtcgcaccgnccctttgtggtggtgcaggctcggctgggcgacagcaggcaccgcattcgcaagcgaggcctggagtgcgatggccggaccaacctctgttgcaggcaacagttcttcattgacttccgcctcatcggctggaacgactggatcatagcacccaccggctactacgggaactactgtgagggcagctgcccagcctacctggcaggggtccccggctctgcctcctccttccacacggctgtggtgaaccagtaccgcatgcggggtctgaaccccggcacggtgaactcctgctgcattcccaccaagctgagcaccatgtccatgctgtacttcgatgatgagtacaacatcgtcaagcgggacgtgcccaacatgattgtggaggagtgcggctgcgcctgacagtgcaaggcaggggcacggtggtggggcacggagggcagtcccgggtgggcttcttccagcccccgcgggaacggggtacacggtgggctgagtacagtcattctgttgggctgtggagatagtgccagggtgcggcctgagatatttttctacagcttcatagagcaaccagtcaaaaccagagcgagaaccctcaactgacatgaaatactttaaaatgcacacgtagccacgcacagccagacgcatcctgccacccacacagcagcctccaggataccagcaaatggatgcggtgacaaatggcagcttagctacaaatgcctgtcagtcggagagaatggggtgagcagccaccattcccaccagctggcccggccacgtctcgaagttgcgccttcccgagcacacataaaagcacaaagacagagacgcagagagagagagagagccacggagaggaaaagcagatgcaggggtggggagcgcagctcggcggaggctgcgtgtgccccgtggcttttaccaggcctgctctgcctggctcgatgtctgcttcttcccagcctgggatccttcgtgcttcaaggcctggggagcctgtccttccatgcccttgtcgagggaaagagacccagaaaggacacaacccgtcagagacctgggagcaggggcaatgaccgtttgactgtttgtggcttgggcctctgacatgacttatgtgtgtgtgtgtttttggggtggggagggagggagagaagagggggctaaatttgatgctttaactgatctccaacagttgacaggtcatccttgccagttgtataactgaaaaaggacttttctaccaggtatgaccttttaagtgaaaatctgaattgttctaaatggaaagaaaaaaagttgcaatctgtgcccttcattggggacattcctctaggactggtttggggacgggtgggaatgacccctaggcaaggggatgagaccgcaggaggaaatggcggggaggaggcattcttgaactgctgaggatggggggtgtcccctcagcggaggccaagggaggggagcagcctagttggtcttggagagatggggaaggctttcagctgatttgcagaagttgcccatgtgggccccagccatcagggctggccgtggacgtggcccctgcccactcacctgcccgcctgcccgcccgcccgcatagcacttgcagacctgcctgaacgcacatgacatagcacttgccgatctgcgtgtgtccagaagtggcccttggccgagcgccgaactcgctcgccctctagatgtccaagtgccacgtgaactatgcaatttaaagggttgacccacactagacgaaactggactcgtacgactctttttatattttttatacttgaaatgaaatcctttgcttcttttttaagcgaatgattgcttttaatgtttgcactgatttagttgcatgattagtcagaaactgccatttgaaaaaaagttatttttatagcagcaaaaaaaaaaaaaaaagaatacagttaaatgtattatacataattttggaaccaaagaggccaacagatcagttttaattttattagacggtgaggccatctgagatgaggtggacgttctgagcagtcccttgagtggcctgccaacgtttcagggtatgaatggattttgtttattcggtttgatgtgtcttttccatccttacacacccagaaggtagagtaaaaatgactatgatagaatgcaggtgtgtatccttaaatcctcatctttatgtttatttaataaagctccccttagattctgtttcataataatttaaaaccaaacaattttcccatagacttgctgttaaagtattgtacgtttgtgtacagtttaagaaaataaaagattgagtgccacgggcaaactg

SEQ ID NO: 66532 - DNA, 1123 bp, Homo sapiens
gcacgagggttattgttatattcagtaagtcacaattctctttgatggctgagcagggaagccatgagtgttctctgaaccacatcattgtttaaacttaaaagatagtgggctattaaacttatattctgaaataattgtactctcacaagaacttggaaaaatagtacagagaggtctcatgcatccatcacccacatgcctcaccagtgacatcttacgtaactatagtccattatcaaaaccaggaaactgaccttgtgtgcccactgtcttttatgtccctagttttcctaatgactaatgatttcatttaagatctctcatttctgtttctcttggaaagagaatcaaataccacatgagtctctgtcagctgccaaaatgcccataactgtttaacttacttcacaaaggtacatagatgacgattatgttggtgcatctttcaatataagcatatgtacctatactggagatttagtgtgtagtctaccaacatataagcaatatgtatctggcatatccttccccataaagaatcctaccctttgttaattgggttggaaatagatacaggttatcatctggaatcagagcacccaggatgttgtagatggatgtacccattacagtaagtccgactttgaagtgcctgaaacaccgctcaagggaacagctggccctcactttttccattttatgccagtgttattctgctcattctttcctgatttatgtggccttgtaaatattgtttgtattgctgtgaaatatttggcatgtgtcaagtgatgatgttctgttcagtactgcacattaatggacggaatctgaaattatactttgagctacataacttgcagaagaaacttcatatgtcagggaggtgcagtgtcccagaactttgggaggccaaggtgagcagatcacctgaggccaggagttcgaaaccagcctggccaacatggtgaaaccccctctctatttaaaaaagaagagaaaaaaagcaacttcatagtgtgccaagcttttgttcagaaggagcaactcagtgttgagcaagaatttatgaagatagtggaggtggagtttttagtctacaccatgaattgagaacaga

SEQ ID NO: 66533 - DNA, 411 bp, Homo sapiens
gactttggagcctaaacttgggaagagttgacttggtagagtggacagagccatcagctggatagaagattgcacctgacctcacccttgtcaagcccaagaatacataagtgcttgctggaggtatggagtataggaagagagaaggccaaagaaagcagatgccaataattggtcttctgccatccttgtcagataaattacttctgaaaagaagggctaaaggttttcctccaaccttcattcctttggggaacatcctttctcttcaatttacaatcataaggagtgggattaatgagcataacccccctatatggaagttagatcttaaatttctcttctttagaaataatgcccagagggaattagtcaaaaataagattccaccccctaagccaaaaaaaaaaa

SEQ ID NO: 66534 - DNA, 2071 bp, Homo sapiens
  misc_feature (1)..(1): n is a, c, g, or t
  misc_feature (107)..(107): n is a, c, g, or t
  misc_feature (460)..(460): n is a, c, g, or t
  misc_feature (523)..(523): n is a, c, g, or t
  misc_feature (941)..(941): n is a, c, g, or t
  misc_feature (1199)..(1199): n is a, c, g, or t
  misc_feature (1837)..(1837): n is a, c, g, or t
  misc_feature (1860)..(1860): n is a, c, g, or t
  misc_feature (1884)..(1884): n is a, c, g, or t
  misc_feature (1891)..(1891): n is a, c, g, or t
  misc_feature (1904)..(1904): n is a, c, g, or t
  misc_feature (1915)..(1915): n is a, c, g, or t
  misc_feature (1919)..(1919): n is a, c, g, or t
  misc_feature (1981)..(1981): n is a, c, g, or t
  misc_feature (1984)..(1984): n is a, c, g, or t
  misc_feature (1995)..(1995): n is a, c, g, or t
  misc_feature (2008)..(2008): n is a, c, g, or t
  misc_feature (2013)..(2013): n is a, c, g, or t
  misc_feature (2020)..(2020): n is a, c, g, or t
  misc_feature (2038)..(2038): n is a, c, g, or t
ntctacaaggaacttaaacaactttacaaaaaaacaaacaataccatcaaaaattgggcaaagggtatgaacagacacttctcaaaagaagacattcatgcaaccancaaacttatgaaaaatagctcaacatcactgatcattagagaaatgcagttcaaaaccacaatgagatatcatctcatgccagtcactatggtgattatcaaaatgtcaggaaacgatagatgctggcgaggctgtgggaaaataggaattcttttacactgttggtgggaatgtaaattagttcaacaattgtggtagatgtgtggcaattcctcaaggatctagaaccagaaataccatttgacccagcaatcccattactgggtatatacctaaaggaatataagtttgcctactttctacttcaaagtatttgtggaaagaatgtgacagatcaacagataaatacatnttgaaaatgactggactgggtagtctttcagtccttctatcctgacattgtaaggtccataangacaacaggtatagtaacttgagttaacaaaggttttcatatgcagggacttgatgggattcatcacaaccttgcaaataatgttctgtagcaaaaagtcattcaattttgaatgagaagatctgggtatacaacgtgattcaccattaggaggtatattagtcaaaacatggaaaatatttaagccttattatccttttttataacttgggatctgtaagactgctttgtgaatttcactgtgttattatgaagattattataataacatatgggacatttctttgtaaaccataatatggccatgaaaatattagtgtttttatatctcttgctattgttatctcaatcttttctattcaatttttcatagaagaatttaagtcttcacctaagatcacagcattaagatttattnttgagtttgtccagtgaagtactctttcctcataaaataatacattttgatgacattaagaaaaaaaaacccagaagaagctaccattaatattaccatgttttgacttagtatttataaggaaacataatttctaaataagtaaaaatatatttggtatgatttatttaaatttcatattgaacatttatttatgattcttcacaagtatttctgatattctcgttttcaccagaagaggccactatgaccaaactntctgaatttattatcaatttgaacaattccatttagtttagaaaattgttatgcatgtcaaaagtcaatgatcaggagtaagtctttttcctctttaagctccttttgaaaagcagccttccaactgagagtagtaaacatatacattcttccctctgatttcttgtaaaaagccacagttttaaaggttgatagacatagattcaagtcttagttctaccacagagacaaactgcttaaccttggcaaatagcttaaacttgttcacttttctaaaaagaaaataatgatatctagcttttttttaaagattaaataagctatgattactaaattacttaaaacagtggcttaacacaaatgaacaaatactagttccggttactctagaatgtctggtatatcctttgtcagcaagcagtttttaacggatcctaaaatgctttaggtatttttacgtgaaaatgaaaaaaatgaatggaagatcaatttcaagaatgtttacgaggttaatatgcggaagtttgaatagttgatgaggggagattatgaatttatttgttttttttctataaagtacataatttcacagtggctcatgcatgtgaccctagcactttgagaggcagaggtgggcngatcacttgaggtcaagagttcnagacctgcctgggtaatatgatgnaaccccntctctaccaaaantacaaaaattngctnggtgtggtggcatgcacctgtaatcccagctacttgggaggctgaggtgggagaatttgctngancctggaaggcngaggttgcagtgngccangatcgcnccactgcacttcagcccngcgagagagcaagactctatttcaaaaaaaaaa

SEQ ID NO: 66535 - DNA, 367 bp, Homo sapiens
tagtcagttattgctgcactagagctaaataaaagacataaatatctaaggcacttactggaataaacatcttatttccgctaagaggttggctagggaagctctgcttcagagtatgggttgagtataagcctgttccacatgtcttttgctctgggaccaggcgttgtgcagcccatccttttctcaagacaaaagccaagccaagcaaggacatttaaagcttcacttctgctcacatcatatctattggccaaacattccattggccaaagcaaatcacatggccaagtcaagcatcagtagtctggggaatattcttcctctactctagacacatggaaaaggttatgcatactaattctat

SEQ ID NO: 66536 - DNA, 2185 bp, Homo sapiens
ggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactcctgacctcataatctgcctgtctcagcctcccaaatgcttggattacaggcttgagccaccacgcccggccatgtgtgtccttttaagggaagtaccatatgtgactgctgatggtaacatttcttgtatgcagcaggaaaacctgcaggctatacgcaaggtatgtgaataaagactgtggattgaagggggaaaagttgataatacatacccatgataagaattcatattttctctttctttgtctcttcatacagaagcaagttcgagcagagaaggttagcagttacagcacttaaaagtttaggattgagggtttttggttggtttttttgttttttcatatttcactgttgctgaacattgatttagtcttccaaaatggacatcactagtaagtgcactgaatactgaaatacgctgattggcaagcatatatctgtagctagaatttttttaaccgtaattccagaatttaaaaaggtaagagatctgctttttgatagaggccttttaaaaagactatataacatttctatttggctgtttatgtgaatgctcagggaatttggacatgtgttttatacagaagtggctttttatatttcttcaagtgataaattagcattaggacatatcagatagaacaggccagtttcctgatgagattggtagagatgttacggtaggttcatccttcctttttccatgttatatgtggagaagtgttaaacttgctcaagcaaatgggagtaggagataggctgaaaatagagattgctacaccattctattttgttttcatgcctgttttttctccaatcctatatggacatttgagaaatggaccacaaatctgagagggatagagtaaaaagaggcattaatgtatgtactcacaagttagacctattttgctgttaaaataggtctggtcttgtcataggtcataggaattgtgtagtttgagttgctgcgagaaagagtcaagaacttagacttgaatgggaaggccaactggtgagggaagtggggtattatctactcaaatgttctaagctaatacaaaacaattacctggcaagcatccccctctgcccttcttgagattctgaatgaacttagaatcagatcaatggtgagacccagttatgtaactttcctttgaagttctaaaggataattgaaaataaagtagtctggcatgtttaacagtaaggagtgacactaaaatttgaatataacagtatgttgcaactatttataatagacctatttatgttttgagaactaagtaaaatgctatgaaaaattcacataaagcacgtaagcaccaaatgaaaatcatttcgtgctttcaaattaatgatactaggcttgtaggatgtcttagaatcatgtttaacaagaagttaaaatatttgcattttgaaatttttatgcagtttggctaaggaggaacttggaaaataacattcatcagcttctacactgcactttttgtatgtggactttgtaaagtttaatgtccgtttaacagttgcttgtttatttgtgtaaacctagctagtaaatattgatgatgttcagggccactgacttgcacagcccttggagcactattcacacagaacacaattcagagtttgttaagacattaacacactttgatatctattccaaaaatacttttgttaccacaggttcattgctgtcatttagacaaaattaatgtactgtgatattttcccactcttaagatgatgttgcccagcctagtactgtcagaaattcagttctgatgtctgtgtgtgcaagatattaatgtggtccctgtaagaaataccagagttggtcatgatttactaaggagatgtaatattttctttgacctgttaggaatataacttgtgtcttgatttgttgcacatcatattttttgcaacattaatgaatttaaataaattaattggaacgtt

SEQ ID NO: 66537 - DNA, 2590 bp, Homo sapiens
ggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactcctgacctcataatctgcctgtctcagcctcccaaatgcttggattacaggcttgagccaccacgcccggccatgtgtgtccttttaagggaagtaccatatgtgactgctgatggtaacatttcttgtatgcagcaggaaaacctgcaggctatacgcaaggtatgtgaataaagactgtggattgaagggggaaaagttgataatacatacccatgataagaattcatattttctctttctttgtctcttcatacagaagcaagttcgagcagagaaggttagcagttacagcacttaaaagtttaggattgagggtttttggttggtttttttgttttttcatatttcactgttgctgaacattgatttagtcttccaaaatggacatcactagtaagtgcactgaatactgaaatacgctgattggcaagcatatatctgtagctagaatttttttaaccgtaattccagaatttaaaaaggtaagagatctgctttttgatagaggccttttaaaaagactatataacatttctatttggctgtttatgtgaatgctcagggaatttggacatgtgttttatacagaagtggctttttatatttcttcaagtgataaattagcattaggacatatcagatagaacaggccagtttcctgatgagattggtagagatgttacggtaggttcatccttcctttttccatgttatatgtggagaagtgttaaacttgctcaagcaaatgggagtaggagataggctgaaaatagagattgctacaccattctattttgttttcatgcctgttttttctccaatcctatatggacatttgagaaatggaccacaaatctgagagggatagagtaaaaagaggcattaatgtatgtactcacaagttagacctattttgctgttaaaataggtctggtcttgtcataggtcataggaattgtgtagtttgagttgctgcgagaaagagtcaagaacttagacttgaatgggaaggccaactggtgagggaagtggggtattatctactcaaatgttctaagctaatacaaaacaattacctggcaagcatccccctctgcccttcttgagattctgaatgaacttagaatcagatcaatggtgagacccagttatgtaactttcctttgaagttctaaaggataattgaaaataaagtagtctggcatgtttaacagtaaggagtgacactaaaatttgaatataacagtatgttgcaactatttataatagacctatttatgttttgagaactaagtaaaatgctatgaaaaattcacataaagcacgtaagcaccaaatgaaaatcatttcgtgctttcaaattaatgatactaggcttgtaggatgtcttagaatcatgtttaacaagaagttaaaatatttgcattttgaaatttttatgcagtttggctaaggaggaacttggaaaataacattcatcagcttctacactgcactttttgtatgtggactttgtaaagtttaatgtccgtttaacagttgcttgtttatttgtgtaaacctagctagtaaatattgatgatgttcagggccactgacttgcacagcccttggagcactattcacacagaacacaattcagagtttgttaagacattaacacactttgatatctattccaaaaatacttttgttaccacaggttcattgctgtcatttagacaaaattaatgtactgtgatattttcccactcttaagatgatgttgcccagcctagtactgtcagaaattcagttctgatgtctgtgtgtgcaagatattaatgtggtccctgtaagaaataccagagttggtcatgatttactaaggagatgtaatattttctttgacctgttaggaatataacttgtgtcttgatttgttgcacatcatattttttgcaacattaatgaatttaaataaattaattggaacgttaaaaaaaaaaaaaaaaaaacaaaaaaaaaaaaaaaaaaaaaaaaagaaaaaaaaaaaacacaacaaaagaaaaagaaaaaaaaataacaaacacagaagccaatgcagtggagcacgccacacacatagtctcacagccaagaagtgccactgaacacatgcatagcacgaacatggaaacagcaatacaaacaagactagacgacgctcttatacaataacacggactactccaaccacaacaacaccacgttatgtagctcgcacaatcagcatgatatctatcactacataaataaacgatagacagaaacaaaatatcaacacgccctcatgcgagatataaataaatatgacagagaaagcaacataagatcaacaagaaagcgttcgatccgcaaacat

SEQ ID NO: 66538 - DNA, 915 bp, Homo sapiens
cgtctagaggatcccggagctcctagcctgtggccctcctttgaggatcgaatgaacttagaatcagatcaatggtgagacccagttatgtaactttcctttgaagttctaaaggataattgaaaataaagtagtctggcatgtttaacagtaaggagtgacactaaaatttgaatataacagtatgttgcaactatttataatagacctatttatgttttgagaactaagtaaaatgctatgaaaaattcacataaagcacgtaagcaccaaatgaaaatcatttcgtgctttcaaattaatgatactaggcttgtaggatgtcttagaatcatgtttaacaagaagttaaaatatttgcattttgaaatttttatgcagtttggctaaggaggaacttggaaaataacattcatcagcttctacactgcactttttgtatgtggactttgtaaagtttaatgtccgtttaacagttgcttgtttatttgtgtaaacctagctagtaaatattgatgatgttcagggccactgacttgcacagcccttggagcactattcacacagaacacaattcagagtttgttaagacattaacacactttgatatctattccaaaaatacttttgttaccacaggttcattgctgtcatttagacaaaattaatgtactgtgatattttcccactcttaagatgatgttgcccagcctagtactgtcagaaattcagttctgatgtctgtgtgtgcaagatattaatgtggtccctgtaagaaataccagagttggtcatgatttactaaggagatgtaatattttctttgacctgttaggaatataacttgtgtcttgatttgttgcacatcatattttttgcaacattaatgaatttaaataaattaattggaacgtt

SEQ ID NO: 66539 - DNA, 215 bp, Homo sapiens
tctcgtgtatcatttcactaaatttccttacattgatattctagctcatgaattctttcttctactctggctcatctgtagtctaatttattcaatgagttataaatttcaaataattaaatttttatttctaagtattgtttttattatttaagaaaaatctttttgaatttatctataatgtcctgtttctgctatgtttctatttttttaaa

SEQ ID NO: 66540 - DNA, 362 bp, Homo sapiens
atttactgcttcgactgccagctcattggtagcagctgaggctgcagcaattgataagaaacaatccctgctcttatgctcacattctagtagggaaagacagataggtatacaaattattgtaatacaggataacagaaatatatgtgtggtgctgtactagcagagttttgtaaagtttatttgctgtcctgaggccagtagaaaagaaaggggaggaaggtattctggttcagaagggctaagggacctgattggctgaggcaggagaatcgcttgaatccgggaggcagaggttgcagtgagttgggattgtgccactgcagtccaacttgggcgacagagtgagactctgtctagga

SEQ ID NO: 66541 - DNA, 821 bp, Homo sapiens
ctttaggtcctctgtttattctgtcaaatgaaagtgttaggccaaggtcgcattatctctttggaaactacatcgagaacagaattcccatggaacgaactcttaatagttcactggtagtcccccttttctgaatattcttcccaacatgacactttataacaaaaatttaactgcaaaactctttttttttcaccaacagccagattttgatgagaaaatggccatatttatttactccaaatatatattatgtctgtgataatttgcctaaactgtttaaggaatattaacaagtatgatactgcatcgtggtatgtagcaaaaagataggtaatctgacatacatggatgcaagcagcatggctgtgaacctggatatatttagaaatgatcttcagtggagtccttgatgtgacattttccactaaaacattcttctaactctggtatatcttagtgtttcgaactataatttccgtcttcaagccaagacagcagctctacatccttacctaggtaattcaggcatgcgccagtattttggaggggtccaaattagagttagttatgatggtatagatctttaaagtatagtctaaccaagcttgctctggtcttttgtgacatcaaggcttctcagtctgtattcacataaagttgaaacaactaatcaattcagtgaaaaaaaatcagcagatttcactcatacactggtgatatataccactggtattgggtacaatgtaaggagagaggattacccatctcttcagttacttgtaaaatatgattttaaaaaaataaatcaatacattttg

SEQ ID NO: 66542 - DNA, 1041 bp, Homo sapiens
cgacttcgttcgaggttggcgcccgcctttttcagagagcacttcttagtgggtattccgtccggggccacttttctgaggccgaaggacccctagtcagtgtgtgagacatagcctggccgagcctgggaaccacctggggctgagagacgaccttaagtggacagagattctagaacaggagaaataaaacagctatcgtttgggagcaatgagtttaaaaccctttacctacccgtttccagagacgaggtttcttcatgcaggacccaatgtgtataaattcaaaatcagatatgggaagagtatcagaggagaagagatagaaaataaggaagtcatcacccaggagctggaggtcccagttgagaagaaagcagtaggagctgtgatgaggaaacgaaaacacatggacgagcccagctcccccagcaggccagggctggacagggccaagatagggacttccagccaaggccccagcaaaaagaagccccctgtggaaaccaggagaaatagggaaagaaaaacccaacaaggattgcaggagactctggcctctgatatcactgatgtccagaaacaagattctgagtggggacacagcctgccagggcgaattgtcccacccctgcagcacaactcacctccacctaaggagcgagcagccaccggcttctttgggtttctaagctctctcttcccgtttcgatatttcttcaggaagagcagccactcttgagccttccaaatgcagcgctggaaagaggatcatctcttgtagtgactcctcccgagccattcttcctccaactctatccttttcttatgacacttcagtcgtggggaatgaggtccccatgctgagtcctctgtggttttatcgtgtcctttgcccctttataatagattttttcccccaatttaaaacattaagaatggaactttctaaaatgttcatgtcctgagggccggtttaggccttttgtcttcggcacttaggatcctaatgacaataaattatttatgaagagataaaaa

SEQ ID NO: 66543 - DNA, 847 bp, Homo sapiens
cgacttcgttcgaggttggcgcccgcctttttcagagagcacttcttagtgggtattccgtccggggccacttttctgaggccgaaggacccctagtcagtgtgtgagacatagcctggccgagcctgggaaccacctggggctgagagacgaccttaagtggacagagattctagaacaggagaaataaaacagctatcgtttgggagcaatgagtttaaaaccctttacctacccgtttccagagacgaggtttcttcatgcaggacccaatgtgtataaattcaaaatcagatatgggaagagtatcagaggagaagagatagaaaataaggaagtcatcacccaggagctggaggtcccagttgagaagaaagcagtaggagctgtgatgaggaaacgaaaacacatggacgagcccagctcccccagcaggccagggctggacagggccaagatagggacttccagccaaggccccagcaaaaagaagccccctgtggaaaccaggagaaatagggaaagaaaaacccaacaaggattgcaggagactctggcctctgatatcactgatgtccagaaacaagattctgagtggggacacagcctgccagggcgaattgtcccacccctgcagcacaactcacctccacctaaggagcgagcagccaccggcttctttgggtttctaagaagccatcatctgtcacatgccagagggtgcccctcaagagtgggagagcaggggctgaactgctgagttcccgctgcgtcctgttgctatgctgcctgcacccttggtggggagaagagaagaggtggactgctgcggaggacctggcaaaca

SEQ ID NO: 66544 - DNA, 365 bp, Homo sapiens
aagatatcttgcaatatcagtgtctgtgggccaaatcagacatcctttttgttgttgttgctgccaccatccccactctccttccctccctagacgcaacctagtacctgcctctcagacactgtattttgcagaaacttaattgataagtaatgtctacatgagctgttaaagggaattttcaaagaatattattattttcttcatttactttttaaaggttagttagatatgtattatagagactgtgtttaggttttttctcttggaaattttacattctaggtttaataactacatttattgaatttagtactatagtaataaatatgagtataaatacctggacttctaaatttaggatt

SEQ ID NO: 66545 - DNA, 931 bp, Homo sapiens
agtaattatggtgcatgcctctttgggtcaaggtgcagaggcttgtgaaatacctttgttttctaggggttgggaaggttcagttgcggaaataggtatgtgccaggaaggctggtggcccagatttaagcctggccagcagaggcaggagtggaggagacaatatagggtaagaaggggatgagtcgatgaaggaagaaaagagacgtggttttcttgggtctgggagcacagaagcaaaaatcactaagcaggtagtcagagactagagagggcagagccactccctttgatgcagagggggcactgaggaacttgccctttcattccaggtttgctggtcgctaggcaggtgtcctagagtgagactggcttagcaagtgggtgtctccttcagagttggttcaggagctcacttccctctacagacacactgtcactgctaggccctagtgttttcctttgttagggctccaagtaatgagaaaggctgccccatgtagggtgccacctcaaatcctttttctcatttcacctcacagtaaccctggtgagccctctacatagtgcctgtccagcccatgcctctgggtaggcagccacataaaaatcaaacacctgttttgttggctaatctggggaggaagaaagggagtgattctttgtgtcatactccacaaagggccatctctggcctaggcagcactgcagaaggcaggaccatgtacctgagactgatgagctgagtcgggtgcgagcctcactcaaggagagggtagagagggtaggtacccacctatcccatccggctctgttctttgagtttatgggacttccttcatcccgatcacttgggtgccattgttacaaggggctggctattcctacttttcttttttctttttcttttcttttttttttttttttgaga

SEQ ID NO: 66546 - DNA, 488 bp, Homo sapiens
gcagtgtccacctttcatttctgtgatcaggacatggctctaaaattgcaagtcctaacttatttgtcttagccagttgtttgtaacccttcgatgttcccattttcctttcaactagaagccccaaatctttttatttatctaaaattcagcttaaaaagggtaatcaggctttatgggacaggtaagagctatctgtataatgattttttttcccccatataagaaatgaaatcatgggaggccaaggcaggaggcttgcttgaggccaggggttcaagaccagcctgggtaacatagtgagagctcgtctctacaaaaacaaaaaacaaacaaacaaaaatggctaggtgtggtggcacacacctgtagtcctagctacttgggaggctgcggtgggagaggatcacttgagctcaggagtttgaggttactgtaagctgtgattgcatccctgtctccaacctgggtgacagagccagactgtt

SEQ ID NO: 66547 - DNA, 261 bp, Homo sapiens
ttaatatacaaccatacctcaaaatattgcaggatcagttccagaccactgccatgaagtcaatattgcaacaaagtgcccaaaaatcatggtctagttttccctgctttcaccctcacaactggagggttcatggagctctccaggggatgacggttgtgccatgcagagcagcatttctaagcaagtgtgagttcatgagtgtgattgaaactgctgtttcacatagaaaggcctgcgtgcagcaggttgcaaacaggt

SEQ ID NO: 66548 - DNA, 3212 bp, Homo sapiens
agaaatcagagacgctgcctgcctgctcccatctctcgcgcgctctctctctcttctgctctctccctcccttgcaaacattggatttaaacctgctcagaattcagcacagaggaaggcagcagcggtagcagcagcagaagcagtagcaagcccggcagctgagagcaccgcagcgtcgagatgtaccatcctgcctactgggtcgtcttctcggcgacaactgccctgctcttcatcccaggagtgcccgtgcgcagcggagatgccaccttccccaaagctatggacaacgtgacggtccggcagggggagagcgccaccctcaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttctgaaaaggattatgggaactatacttgtgtggccacgaacaagcttgggaacaccaatgccagcatcacattgtatgggcctggagcagtcattgatggtgtaaactcggcctccagagcactggcttgtctctggctatcagggaccctcttagcccacttcttcatcaagttttgataagaaatcctaggtcctctgagcaacgcctgcttctcatatcacagactttaatctacactgcggagagcaaaccagcttgggcttctttttgtttttttctgttattctagatttgttttctttttgtttttgtttatttgtttgtttgcttttatttccagcttgaatgagtggggttgggggcggggtgggcagggttctaccacgtgtaggataatcattcattggtgtgtccaaaaatggggtctgctcctgctaccttgacccttccctttcctctgcttctctcctcatcatcattcccaacaacatcctctgccacacacaacaaaacgtaagtttcatttgggcaaaaattgagcctcacaataaacaccctgaagacacaacttgacttataacatagtgcacagcaagagctacatccaagtgtcctattatctgtgattattttcttaatgacaatgtacatatgcccccatccatgttaattattatctaattccattagggttcacgtcttttctttctgggacactatcctactatatccatatctatagatttcaatatagatgattgtgccatcttctgtagcccctccgctctactcattccttccaccatctgcagagatttgaagtttggggctatgcatgaaacccaacactaaattttgcaagtcaagtgaccaaaaaagggggaggcattttgaagatagaacctctattttaaaaagagaagttcaactcataaacgtgattgataggtggctgatttatttaggttttgtcaagctatctatcaaagtaatggtacagttacccatctactcaaatatctgatttatctcaccatccaattatctacccacctgtcttcctctctagcaatctatttactgtttatcaatctatcaatgtaattgtctaacactcctttctattctctccctactactcactatcaattcatccccatatgaatctctaaccatattgtatctctcccactgtattcatttatacaccatcagcagacattggcatcttcaaaattatctttcaacttctgtgaaagccaacgatctcacaggttaacaaaatacaaaagcaataccctgtgttgtggactctttaaaatctggtatcctatccacccaagggagacactaacagataggccaaagtagcaagctaatgatcagtcactcactattcccggaagagcctgtgttttctaaaacactttcttgggaagcagatcagcctagaaaagttttgattagcactgtggttttccttttgcacttgaaggacaaaggtgccagcctttatgcttctctcaacccttcaagaaagtacatgtcaggaacctatggctggctttccttagcagcaagaacttgagagaaaaacacatctgtctctgcaatgcaaagtgaagagtccacccgcctgagtgggatgacttcagctagagtctcctttctgctccagttctggtttaatctgtttgaaaactatccagtaaaaagctgatggaggccaattacatggcgggtgtattgacaactctggtatttgtttcaggaagctcttctaagctgagggcacttgagcaactgacttaattttcaagcacttgattaacacaacactgcaaacagaagggagaaagtgtcagtgacacagtttcctctgatgcagctgcttctccaatggctttggggaagaacttcaccagctcttcaggttcaaagcagacccagcatacaaacaagagctgagccacctttgctgtcttgtctcctgggacgagaaggactcatccagcaaagttgcctgggattcaaaataaaggcattgcagaccgcacaggtgtgctgcagggactgatccacagagaggatgagaatgcagcatcaatcgcagacctgccctgcctcagttggaaaaccttttcaggccctcagtctaaaaaataaaaaatatgagcaccaaaaaaaa

SEQ ID NO: 66549 - DNA, 3100 bp, Homo sapiens
gaccaggactgtgcggctgccggagtcctgggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttctgaaaaggattatgggaactatacttgtgtggccacgaacaagcttgggaacaccaatgccagcatcacattgtatgggcctggagcagtcattgatggtgtaaactcggcctccagagcactggcttgtctctggctatcagggaccctcttagcccacttcttcatcaagttttgataagaaatcctaggtcctctgagcaacgcctgcttctcatatcacagactttaatctacactgcggagagcaaaccagcttgggcttctttttgtttttttctgttattctagatttgttttctttttgtttttgtttatttgtttgtttgcttttatttccagcttgaatgagtggggttgggggcggggtgggcagggttctaccacgtgtaggataatcattcattggtgtgtccaaaaatggggtctgctcctgctaccttgacccttccctttcctctgcttctctcctcatcatcattcccaacaacatcctctgccacacacaacaaaacgtaagtttcatttgggcaaaaattgagcctcacaataaacaccctgaagacacaacttgacttataacatagtgcacagcaagagctacatccaagtgtcctattatctgtgattattttcttaatgacaatgtacatatgcccccatccatgttaattattatctaattccattagggttcacgtcttttctttctgggacactatcctactatatccatatctatagatttcaatatagatgattgtgccatcttctgtagcccctccgctctactcattccttccaccatctgcagagatttgaagtttggggctatgcatgaaacccaacactaaattttgcaagtcaagtgaccaaaaaagggggaggcattttgaagatagaacctctattttaaaaagagaagttcaactcataaacgtgattgataggtggctgatttatttaggttttgtcaagctatctatcaaagtaatggtacagttacccatctactcaaatatctgatttatctcaccatccaattatctacccacctgtcttcctctctagcaatctatttactgtttatcaatctatcaatgtaattgtctaacactcctttctattctctccctactactcactatcaattcatccccatatgaatctctaaccatattgtatctctcccactgtattcatttatacaccatcagcagacattggcatcttcaaaattatctttcaacttctgtgaaagccaacgatctcacaggttaacaaaatacaaaagcaataccctgtgttgtggactctttaaaatctggtatcctatccacccaagggagacactaacagataggccaaagtagcaagctaatgatcagtcactcactattcccggaagagcctgtgttttctaaaacactttcttgggaagcagatcagcctagaaaagttttgattagcactgtggttttccttttgcacttgaaggacaaaggtgccagcctttatgcttctctcaacccttcaagaaagtacatgtcaggaacctatggctggctttccttagcagcaagaacttgagagaaaaacacatctgtctctgcaatgcaaagtgaagagtccacccgcctgagtgggatgacttcagctagagtctcctttctgctccagttctggtttaatctgtttgaaaactatccagtaaaaagctgatggaggccaattacatggcgggtgtattgacaactctggtatttgtttcaggaagctcttctaagctgagggcacttgagcaactgacttaattttcaagcacttgattaacacaacactgcaaacagaagggagaaagtgtcagtgacacagtttcctctgatgcagctgcttctccaatggctttggggaagaacttcaccagctcttcaggttcaaagcagacccagcatacaaacaagagctgagccacctttgctgtcttgtctcctgggacgagaaggactcatccagcaaagttgcctgggattcaaaataaaggcattgcagaccgcacaggtgtgctgcagggactgatccacagagaggatgagaatgcagcatcaatcgcagacctgccctgcctcagttggaaaaccttttcaggccctcagtctaaaaaataaaaaatatgagcaccaaaaaaaa

SEQ ID NO: 66550 - DNA, 3967 bp, Homo sapiens
aatacaggctagaggttgaagagcaggcgtgctgaatgagagtggcgtcgcagcgatggccagcgctgaggggtatcaaggtcttattcatgcattctcatgtcttttgactccaagatgccttggaagcattcctttgctcttttcattttcaatttttgaaaaatatacacaacacctgggcaattctgtgttgctcttttgaatctctacatggcctctccatctgcccacttttccaaagggtcatcttgggttttcccctctcctgcagtggactcagtgtcgcctgccaggagaagtgccactgctgctcctctcttctggcccacaattgtccgtgcctgggctacagtgacagccacctgattcatttccctacctctccagtctagtctccacaccacagcgaaggcaatctttagaaaatctttataaaacctccagctcaaaattttctctggctcttcactgtccttcgagcaaaatctgaaaccctgagcataatttatagaagacctgtgactgggctccagctgacctctccagcctcatctctcctcccaccctccctgcctcgctaggttccagctgcacagagaactttcaattcccgcattgctgggcctctgtaaaggctgcacctccccaccaggaaaagctctccccaccacctcttccttcacatggagaattctatcccatcctccaggtcccagcacagtcccacctcccccagggaatgtgcctgactcctctgcattaggttggaggctctccctgctgtgtgcccatggcacactgtgttcctcatgagatcttgagcttcttgaaggcgagggctgtgactggtccaccagttgtatcccaacacctgggacgatgcctggcctgtagcaggtgttcagtgaatatgcattcgtggaatttctaagtgaatgaaggaacacaggtttcacccttgcagtcagtggaaaaagttggtgagggactgaatccttgttctgttgtttatccatgaagcctatatatttctagtgcaaaaggcccagtgggtctcaaaacattcttggaggggtttgacacactgctattagtagtgactcataattccacgattccctgggatacagagaaggcaggggggtagtactgtttgaacaaaaatcttcccaagaccctggcaaagagatcttccttaggaatcagtggcatatgcgtttatgttctttaacagggaaagtaaaagtgagcgcacttttttgaagctcataaatactcatgtgactgtaaatttagaaatgttaattaattgggcctaatgtttgatctggaaaagtacttagcagtcaccaggaatttgccttgaactgactcgaaccacaaatcagaaccgtatttccacaatttaatttttccatgagacaatcataaaaactctgctgggattatattactaaaacctttatatcccattgcattggatatgtttgtaggtgagtaatgttaaatttaaaaaaaaaaattaataaagcatttgtttaggacctctgtatgcttgataaagtaaaaaaaaaatatatgaaaatgttaccctaacctacaataactaaacttgaacataatgataaaagcagaagaaaatagtcattgaaaacactgtagcagagttgaaatgcaacttaaacccttaatgaacttaagcttctttatcaataaagatgtcagtcaatacttaactataaaaatttaaggagtttcatctgatgaccattaagaattatcccaactaataatgtatatagcatttattgtgaaaccacaataaatataaaacacggtagtcaatgtcattaaaacttaaaatggaatgagcgtaatttgaaaaacaaaatagccctggcacttctttttgtttagaacaacgtatagaaagcacatgcctcactgagaatacttagtggaatctcgataaccacaaaagcaattaaatgcttttaaattatagaaaacactaaaatttttaaagttgttcacccttggtagcttttaagtaaggatcacttgtgatttatagttgtagcttttcttgaacacgtcctcttgcactgatgactaacaaagttagttttaaacggaggtttgctggtgggtttttttttttttttaatgaaaagaaacaacaacaaaaaaatcacaccaaggctagaaagatgcatatcagtatctttgctcttttgccttttatgagcaattagagtaaaccataatcatacctcctaaatgagtttctgagtgttaatattagtgctgtactcaaaggaatgtccatgttccacatggaaagtgttaaattactgagattagtgatttgtgtgtatatccatctgttgactgaccatctgtatgtgtgtcactgactgttgcgaggcttctgtgttccttagcagtgcctccaggtcaccataggacatttaattattgcatgacttaaaagattcaatacggcaaccacagcaaagagaaaattctagttctgccactaacacttcctttaacacaactctgctcaaacatgtgcctttcattgcattccaaagttatcgataattaccagctatcattgttttgggtgttttctctgctaatttctattggcatgcattctagatagttgcccattgtaactataaattgactatttaaataaacaaaagcataattcatggaaaactgccattctaaggtatgatgcaagatggtagatattctgcttccttttccatattctatcatagagatgcattactataaatcaggacttggtatatccatttgttacatattttcttaatgtgggagtcaaagtgaagctacatagctaacaagtcttattcatttagtaagttggctgccctctgctgttcataatgtttcttaaacagattcgtttcctctaagagaagtttctatctccccttggcaaaacaaaatactattcttgaaaacagaagttataataattaatgatatcattcagtgtgtaacattagaaactatgaagtttaaaagagtcagaggttagttttcctgtagaagaaatagtatgtctctctaaacagaagagaaattactggaaattctctctcctgtcagttaccctaaaaaccagctccagcaaagccatttcacgaacaattatgcatctataatgatctaaataataattggagaaaaatagtattttatggacattaaaatctcaattaatactattgcaactattgaatcaaatataaattgaattaaatttttaaattcaacagaaaatagcaaattggttactagaatattttgtctctaccaatttcactattacttctgaggtgtaaaccaaatataatactggcataaagaaggaaaaatatctcaagatttctaggcattttcctatgtctaatagtaggatgttctctctgaatttatttattacaaaaataacattacaacaataaagcaaaataatatttaaaagaaagaaaaaacaaacagtcgcaataccagaacaccattgtagtcgtttgtgtatgtgtgacttctttactgtgttcatgcagagacaagctttgtaatacctttgtaactactgtacaggtgcgtggttagattccgttttgactgcttggtatctcattgtaagcatttcccagggacactacacagtctttataattatgatcactacatcttttggataacttaggcttttgcactattttgtcacgatgcctcaaacttttctatcattgtctgtaattactcctataatcttttattataaaatattgaaacaaagtcacatcactaaaaacactgtgagtataatttattagtaagtgtagactgtgtatcattagcaaaacttgtaaatgcaacgagtcaataaaacagtagaacaatgtcaaaa

SEQ ID NO: 66551 - DNA, 3987 bp, Homo sapiens
aatacaggctagaggttgaagagcaggcgtgctgaatgagagtggcgtcgcagcgatggccagcgctgaggggtatcaaggtcttattcatgcattctcatgtcttttgactccaagatgccttggaagcattcctttgctcttttcattttcaatttttgaaaaatatacacaacacctgggcaattctgtgttgctcttttgaatctctacatggcctctccatctgcccacttttccaaagggtcatcttgggttttcccctctcctgcagtggactcagtgtcgcctgccaggagaagtgccactgctgctcctctcttctggcccacaattgtccgtgcctgggctacagtgacagccacctgattcatttccctacctctccagtctagtctccacaccacagcgaaggcaatctttagaaaatctttataaaacctccagctcaaaattttctctggctcttcactgtccttcgagcaaaatctgaaaccctgagcataatttatagaagacctgtgactgggctccagctgacctctccagcctcatctctcctcccaccctccctgcctcgctaggttccagctgcacagagaactttcaattcccgcattgctgggcctctgtaaaggctgcacctccccaccaggaaaagctctccccaccacctcttccttcacatggagaattctatcccatcctccaggtcccagcacagtcccacctcccccagggaatgtgcctgactcctctgcattaggttggaggctctccctgctgtgtgcccatggcacactgtgttcctcatgagatcttgagcttcttgaaggcgagggctgtgactggtccaccagttgtatcccaacacctgggacgatgcctggcctgtagcaggtgttcagtgaatatgcattcgtggaatttctaagtgaatgaaggaacacaggtttcacccttgcagtcagtggaaaaagttggtgagggactgaatccttgttctgttgtttatccatgaagcctatatatttctagtgcaaaaggcccagtgggtctcaaaacattcttggaggggtttgacacactgctattagtagtgactcataattccacgattccctgggatacagagaaggcaggggggtagtactgtttgaacaaaaatcttcccaagaccctggcaaagagatcttccttaggaatcagtggcatatgcgtttatgttctttaacagggaaagtaaaagtgagcgcacttttttgaagctcataaatactcatgtgactgtaaatttagaaatgttaattaattgggcctaatgtttgatctggaaaagtacttagcagtcaccaggaatttgccttgaactgactcgaaccacaaatcagaaccgtatttccacaatttaatttttccatgagacaatcataaaaactctgctgggattatattactaaaacctttatatcccattgcattggatatgtttgtaggtgagtaatgttaaatttaaaaaaaaaaattaataaagcatttgtttaggacctctgtatgcttgataaagtaaaaaaaaaatatatgaaaatgttaccctaacctacaataactaaacttgaacataatgataaaagcagaagaaaatagtcattgaaaacactgtagcagagttgaaatgcaacttaaacccttaatgaacttaagcttctttatcaataaagatgtcagtcaatacttaactataaaaatttaaggagtttcatctgatgaccattaagaattatcccaactaataatgtatatagcatttattgtgaaaccacaataaatataaaacacggtagtcaatgtcattaaaacttaaaatggaatgagcgtaatttgaaaaacaaaatagccctggcacttctttttgtttagaacaacgtatagaaagcacatgcctcactgagaatacttagtggaatctcgataaccacaaaagcaattaaatgcttttaaattatagaaaacactaaaatttttaaagttgttcacccttggtagcttttaagtaaggatcacttgtgatttatagttgtagcttttcttgaacacgtcctcttgcactgatgactaacaaagttagttttaaacggaggtttgctggtgggtttttttttttttttaatgaaaagaaacaacaacaaaaaaatcacaccaaggctagaaagatgcatatcagtatctttgctcttttgccttttatgagcaattagagtaaaccataatcatacctcctaaatgagtttctgagtgttaatattagtgctgtactcaaaggaatgtccatgttccacatggaaagtgttaaattactgagattagtgatttgtgtgtatatccatctgttgactgaccatctgtatgtgtgtcactgactgttgcgaggcttctgtgttccttagcagtgcctccaggtcaccataggacatttaattattgcatgacttaaaagattcaatacggcaaccacagcaaagagaaaattctagttctgccactaacacttcctttaacacaactctgctcaaacatgtgcctttcattgcattccaaagttatcgataattaccagctatcattgttttgggtgttttctctgctaatttctattggcatgcattctagatagttgcccattgtaactataaattgactatttaaataaacaaaagcataattcatggaaaactgccattctaaggtatgatgcaagatggtagatattctgcttccttttccatattctatcatagagatgcattactataaatcaggacttggtatatccatttgttacatattttcttaatgtgggagtcaaagtgaagctacatagctaacaagtcttattcatttagtaagttggctgccctctgctgttcataatgtttcttaaacagattcgtttcctctaagagaagtttctatctccccttggcaaaacaaaatactattcttgaaaacagaagttataataattaatgatatcattcagtgtgtaacattagaaactatgaagtttaaaagagtcagaggttagttttcctgtagaagaaatagtatgtctctctaaacagaagagaaattactggaaattctctctcctgtcagttaccctaaaaaccagctccagcaaagccatttcacgaacaattatgcatctataatgatctaaataataattggagaaaaatagtattttatggacattaaaatctcaattaatactattgcaactattgaatcaaatataaattgaattaaatttttaaattcaacagaaaatagcaaattggttactagaatattttgtctctaccaatttcactattacttctgaggtgtaaaccaaatataatactggcataaagaaggaaaaatatctcaagatttctaggcattttcctatgtctaatagtaggatgttctctctgaatttatttattacaaaaataacattacaacaataaagcaaaataatatttaaaagaaagaaaaaacaaacagtcgcaataccagaacaccattgtagtcgtttgtgtatgtgtgacttctttactgtgttcatgcagagacaagctttgtaatacctttgtaactactgtacaggtgcgtggttagattccgttttgactgcttggtatctcattgtaagcatttcccagggacactacacagtctttataattatgatcactacatcttttggataacttaggcttttgcactattttgtcacgatgcctcaaacttttctatcattgtctgtaattactcctataatcttttattataaaatattgaaacaaagtcacatcactaaaaacactgtgagtataatttattagtaagtgtagactgtgtatcattagcaaaacttgtaaatgcaacgagtcaataaaacagtagaacaatgtcaaaaaaaaacacccacaaacagca

SEQ ID NO: 66552 - DNA, 1052 bp, Homo sapiens
  misc_feature (153)..(153): n is a, c, g, or t
tggcgcatgcctgtggtcccagctactcaggaggccgaggtaggaggatcacgagctcgggcagttgaggctgcagtgagccatgattgtgccactgcactccagcctgggtaacagagtgagaacttgtctcaaaaaataaggaaaagtatnaaaacaagaaagagatcactttacaggaaagaaatagtatgtctctctaaacagaagagaaattactggaaattctctctcctgtcagttaccctaaaaaccagctccagcaaagccatttcacgaacaattatgcatctataatgatctaaataataattggagaaaaatagtattttatggacattaaaatctcaattaatactattgcaactattgaatcaaatataaattgaattaaatttttaaattcaacagaaaatagcaaattggttactagaatattttgtctctaccaatttcactattacttctgaggtgtaaaccaaatataatactggcataaagaaggaaaaatatctcaagatttctaggcattttcctatgtctaatagtaggatgttctctctgaatttatttattacaaaaataacattacaacaataaagcaaaataatatttaaaagaaagaaaaaacaaacagtcgcaataccagaacaccattgtagtcgtttgtgtatgtgtgacttctttactgtgttcatgcagagacaagctttgtaatacctttgtaactactgtacaggtgcgtggttagattccgttttgactgcttggtatctcattgtaagcatttcccagggacactacacagtctttataattatgatcactacatcttttggataacttaggcttttgcactattttgtcacgatgcctcaaacttttctatcattgtctgtaattactcctataatcttttattataaaatattgaaacaaagtcacatcactaaaaacactgtgagtataatttattagtaagtgtagactgtgtatcattagcaaaacttgtaaatgcaacgagtcaataaaacagtagaacaatgtcaaaa

SEQ ID NO: 66553 - DNA, 797 bp, Homo sapiens
  misc_feature (794)..(795): n is a, c, g, or t
  misc_feature (797)..(797): n is a, c, g, or t
cgaaggcttcattataattttatcaatcaaattcttagaagagggaaaaagtctgttctccccaccctcccccctcactcgtccccccccttcactctcactttcttccattcataatttcctatgatgcacctcaaacaacttcctggactggggatcccggctaaatatagctgtttctgtcttacaacacaggctccagtatataaatcaggcaaattccccatttgagcatgaacctctgaaaactgccggcatctgaggtttcctccaaggccctctgaagtgcagcccataatgaaggtcttggcggcaggtaaatacacccgccccgcgccggcttcgcgtccccgctgcggggcgcggcggcaacttggggcgcttggcagcgcgagccggacgcccacccgccgcagacacacgaacacttggggcgcccgcgcagccaccggaggcgctgggtggcggcccggagcgagcgcgggcacatggtcccaagcaccgcacgccccgcggcaggttggcggcgagggagggggcgccgagccttcctcctcctcctcttcttccccctctccttctcctcctcctcctcctcgctccggacactcgctggctgctcttccctctgcgctttctcccagattcactctccctctctctttttcttttctttctttctttccgctttctcctttccaaccgcggtcccgggctgctcccagggaggggcgcgggcggcgagcagcttgcaaactccggcctgggacgggagcaggtgcccctcgtgccanntn

SEQ ID NO: 66554 - DNA, 2170 bp, Homo sapiens
cgaaggcttcattataattttatcaatcaaattcttagaagagggaaaaagtctgttctccccaccctcccccctcactcgtccccccccttcactctcactttcttccattcataatttcctatgatgcacctcaaacaacttcctggactggggatcccggctaaatatagctgtttctgtcttacaacacaggctccagtatataaatcaggcaaattccccatttgagcatgaacctctgaaaactgccggcatctgaggtttcctccaaggccctctgaagtgcagcccataatgaaggtcttggcggcaggagttgtgcccctgctgttggttctgcactggaaacatggggcggggagccccctccccatcacccctgtcaacgccacctgtgccatacgccacccatgtcacaacaacctcatgaaccagatcaggagccaactggcacagctcaatggcagtgccaatgccctctttattctctattacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctggcagaccccgagggtgcctggccagtccactccactctgggctgggctgtgatgaagctgagcagagtggaaacttccatagggagggagctagaagaaggtgccccttcctctgggagattgtggactggggagcgtgggctggacttctgcctctacttgtccctttggccccttgctcactttgtgcagtgaacaaactacacaagtcatctacaagagccctgaccacagggtgagacagcagggcccaggggagtggaccagcccccagcaaattatcaccatctgtgcctttgctgccccttaggttgggacttaggtgggccagaggggctaggatcccaaaggactccttgtcccctagaagtttgatgagtggaagatagagaggggcctctgggatggaaggctgtcttcttttgaggatgatcagagaacttgggcataggaacaatctggcagaagtttccagaaggaggtcacttggcattcaggctcttggggaggcagagaagccaccttcaggcctgggaaggaagacactgggaggaggagaggcctggaaagctttggtaggttcttcgttctcttccccgtgatcttccctgcagcctgggatggccagggtctgatggctggacctgcagcaggggtttgtggaggtgggtagggcaggggcaggttgctaagtcaggtgcagaggttctgagggacccaggctcttcctctgggtaaaggtctgtaagaaggggctggggtagctcagaagtagacatagtgtgtggggttggagctctggcacccggggaggtagcatttccctgcagatggtacagatgttcctgccttagagtcatctctagttccccacctcaatcccggcatccagccttcagtcccgcccacgtgctagctccgtgggcccaccgtgcggccttagaggtttccctccttcctttccactgaaaagcacatggccttgggtgacaaattcctctttgatgaatgtaccctgtggggatgtttcatactgacagattatttttatttattcaatgtcatatttaaaatatttattttttataccaaatgaatacttttttttttaagaaaaaaaagagaaatgaataaagaatctactct

SEQ ID NO: 66555 - DNA, 123 bp, Homo sapiens
cagtgccaatgccctctttattctctatgtaagttacccctgggatactgacaggagatggcagggagggggcttgtaaatatcattaggggctgtcctgatctgggttgaggggaccttttg

SEQ ID NO: 66556 - DNA, 4098 bp, Homo sapiens
cgaaggcttcattataattttatcaatcaaattcttagaagagggaaaaagtctgttctccccaccctcccccctcactcgtccccccccttcactctcactttcttccattcataatttcctatgatgcacctcaaacaacttcctggactggggatcccggctaaatatagctgtttctgtcttacaacacaggctccagtatataaatcaggcaaattccccatttgagcatgaacctctgaaaactgccggcatctgaggtttcctccaaggccctctgaagtgcagcccataatgaaggtcttggcggcaggagttgtgcccctgctgttggttctgcactggaaacatggggcggggagccccctccccatcacccctgtcaacgccacctgtgccatacgccacccatgtcacaacaacctcatgaaccagatcaggagccaactggcacagctcaatggcagtgccaatgccctctttattctctattacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctggcagaccccgagggtgcctggccagtccactccactctgggctgggctgtgatgaagctgagcagagtggaaacttccatagggagggagctagaagaaggtgccccttcctctgggagattgtggactggggagcgtgggctggacttctgcctctacttgtccctttggccccttgctcactttgtgcagtgaacaaactacacaagtcatctacaagagccctgaccacagggtgagacagcagggcccaggggagtggaccagcccccagcaaattatcaccatctgtgcctttgctgccccttaggttgggacttaggtgggccagaggggctaggatcccaaaggactccttgtcccctagaagtttgatgagtggaagatagagaggggcctctgggatggaaggctgtcttcttttgaggatgatcagagaacttgggcataggaacaatctggcagaagtttccagaaggaggtcacttggcattcaggctcttggggaggcagagaagccaccttcaggcctgggaaggaagacactgggaggaggagaggcctggaaagctttggtaggttcttcgttctcttccccgtgatcttccctgcagcctgggatggccagggtctgatggctggacctgcagcaggggtttgtggaggtgggtagggcaggggcaggttgctaagtcaggtgcagaggttctgagggacccaggctcttcctctgggtaaaggtctgtaagaaggggctggggtagctcagagtagcagctcacatctgaggccctgggaggtcttgtgaggtcacacagaggtacttgagggggactggaggccgtctctggtccccagggcaagggaacagcagaacttagggtcagggtctcagggaaccctgagctccaagcgtgctgtgcgtctgacctggcatgatttctatttattatgatatcctatttatattaacttattggtgctttcagtggccaagttaattcccctttccctggtccctactcaacaaaatatgatgatggctcccgacacaagcgccagggccagggcttagcagggcctggtctggaagtcgacaatgttacaagtggaataagccttacgggtgaagctcagagaagggtcggatctgagagaatggggaggcctgagtgggagtggggggccttgctccacccccatcccctactgtgacttgctttagcgtgtcagggtccaggctgcaggggctgggccaatttgtggagaggccgggtgcctttctgtcttgcttccagggggctggttcacactgttcttgggcgccccagcattgtgttgtgaggcgcactgttcctggcagatattgtgccccctggagcagtgggcaagacagtccttgtggcccaccctgtccttgtttctgtgtccccatgctgcctctgaaatagcgccctggaacaaccctgcccctgcacccagcatgctccgacacagcagggaagctcctcctgtggcccggacacccatagacggtgcggggggcctggctgggccagaccccaggaaggtggggtagactggggggatcagctgcccattgctcccaagaggaggagagggaggctgcagacgcctgggactcagaccaggaagctgtgggccctcctgctccacccccatcccactcccacccatgtctgggctcccaggcagggaacccgatctcttcctttgtgctggggccaggcgagtggagaaacgccctccagtctgagagcaggggagggaaggaggcagcagagttggggcagctgctcagagcagtgttctggcttcttctcaaaccctgagcgggctgccggcctccaagttcctccgacaagatgatggtactaattatggtacttttcactcactttgcacctttccctgtcgctctctaagcactttacctggatggcgcgtgggcagtgtgcaggcaggtcctgaggcctggggttggggtggagggtgcggcccggagttgtccatctgtccatcccaacagcaagacgaggatgtggctgttgagatgtgggccacactcacccttgtccaggatgcagggactgccttctccttcctgcttcatccggcttagcttggggctggctgcattcccccaggatgggcttcgagaaagacaaacttgtctggaaaccagagttgctgattccacccggggggcccggctgactcgcccatcacctcatctccctgtggacttgggagctctgtgccaggcccaccttgcggccctggctctgagtcgctctcccacccagcctggacttggccccatgggacccatcctcagtgctccctccagatcccgtccggcagcttggcgtccaccctgcacagcatcactgaatcacagagcctttgcgtgaaacagctctgccaggccgggagctgggtttctcttccctttttatctgctggtgtggaccacacctgggcctggccggaggaagagagagtttaccaagagagatgtctccgggcccttatttattatttaaacatttttttaaaaagcactgctagtttacttgtctctcctccccatcgtccccatcgtcctccttgtccctgacttggggcacttccaccctgacccagccagtccagctctgccttgccggctctccagagtagacatagtgtgtggggttggagctctggcacccggggaggtagcatttccctgcagatggtacagatgttcctgccttagagtcatctctagttccccacctcaatcccggcatccagccttcagtcccgcccacgtgctagctccgtgggcccaccgtgcggccttagaggtttccctccttcctttccactgaaaagcacatggccttgggtgacaaattcctctttgatgaatgtaccctgtggggatgtttcatactgacagattatttttatttattcaatgtcatatttaaaatatttattttttataccaaatgaatacttttttttttaagaaaaaaaagagaaatgaataaagaatctactct

SEQ ID NO: 66557 - DNA, 1210 bp, Homo sapiens
gttacctagcaggctgtgttctacacagggcttggttctctctcacagcttgtggtaagcgaaattattccaagattcaatgaatacctgctattgagcggcttccctaaccacccaaactggtcttttgttagtggttattgagaggattgtcacagccattgacctacgcaattttacttcaaaagaaatgagcatttttcttcccctttcatttctaaaagcagatatggcaatttgcttaaattgctgtctttaaaagtttagatgattatactttttcccccttgccttttttcttccttttcatttaagcagcacagtgccgtctctttttctgggattggacacggttcctgctgcagggttcatgaagtggttgtgcatgtgtgtgtgtgtgtgtgtgtgtgtgtgtgtgtgtgtatgtatattatctccttacacattagtgttcatttgtctgagaactcttttcagacaaagtaaggctacgttgaactcttcgattaacattttatattttaatgctagggttcattttctctaggccccaatactagaggtttgcgggtgaaaataaaatgaaaatacacctaatggaaaaatctctgtctctttatgtaggaagatatggtagcaactagcctcagagacttaggagtaggcaagataggttacaccttcaagattttatgtctgaagaagaaacagaatttgatctaaatgtaggaagaggaaataaaaggtgcctgtgaagaactaacgctaggaacacagggaagaaagagatgaagatgaaaggttacggctagttggcagaggccaagagagcatcctattcttagacccagcaccttggatctagtttccctgtgttgcagttatctctactatgatgtgcaacaaaccatactgagccatatacttgatgccatatactttatacgtgccaaagaatatgatgcaataaatacattttaaattatagtatggaaaaaataaaaaaaaaatgaaaagactcagttctgtcttcagggaactcacaatctagtagccagactttatccctaatagggataaaggagctgtattgcaaataggccaccatatcagagtggagaccagttgatgtaaaaagcaaacccataactatctttggtgatggtaggctgaacccctcaaagctcagaacccactgataagggtttgt

SEQ ID NO: 66558 - DNA, 814 bp, Homo sapiens
ggttaagtagaactggagattttaagaactggaaaaaaggaaaaggtgaaaagtagcatacaaaattgagaaactaaattctgacggtaattttattaatgaaaataaactttatttaatacaggggaattcttaggtatgaatatttcacataaataaatgtcacaatagcgtcaaatcccagactttcaggaaagtaactgtagcactgttaatatcacaacaacaacaacaaaattctcatctactttgttctgaaaagttttatttttcttaaaaaagaaaaaaaagcaaaccaccccccccaaaaaaaattttttttaaaaataaaaataagaacaaacagaaaccagtctgagctggcagctgtgacagccagtgagacacccgggctttccgggtagtgcttggctttgggctggatgtccacgcagagagccctggagccatcccgcaggtcccacacccaggtacccagaaaatgacggcggccgcacacacgggggctggcggggtccgggccacgctgcagacggggagaggcactcggggtgaaggatcgcggggaaggcactgcggtcggaaccgagaggcaaggcctgggaaagcgccggggacgtcccgtgctccgggacgtcgggtgcccgcgcgggacgccctgtcatgactcacggaggcgagaaagcacgggcagggaaagaggctgcaggatggagggaagcccgaccgtcgggagggaacccaacccgggggaggccccgacctcgcgcgggacggggaagagggcccgccttcccacgccctggccgcccgg

SEQ ID NO: 66559 - DNA, 381 bp, Homo sapiens
aggttggctgcctgtggaggaagggagttcaggtaaagggtgagcagtagaaatattgtagaggacattcaaagatttttaactggtagttaaaccagatgatcctaaaatgctatttatattctgagactccattaaatatttgagcacctactgtttccataacaatgtgagcatcacagcagacagattcagcagtgtgagaaacgagatgactacccatgctggagtattccaatctcatggtggtggtggtaaaataaaaattaaaaaagaaaaaagttggcaaataacattataattctatacaataaaatgcaggatatttaagctatttattcattcaataaatatttgaatgccaataaacttcataagtgt

SEQ ID NO: 66560 - DNA, 218 bp, Homo sapiens
atttttgggatttgtattaaacttctgagaatatttttactagtagaaatcactgttttatttctcaaaattgctaaattattttgagaaactataattatatatttaaaatgtaagttaaatatatgcatatattagcactctatgtatatgtatactaaatatacacacaagtatgtatactatagataaactttcttgtattcttatgtatatgt

SEQ ID NO: 66561 - DNA, 373 bp, Homo sapiens
actgttaaagatgggtggaatagattccaaagctaagatttgaaacttaaactaaatttgaaatttaagattggaatttgaggcccggtgcagtggctcatgcctgtaatcctagcactttgggcaatcaaggtgggaggattgcttaagcccaggagttggagagcagcctgggcaacatggtgaaaccccatctcaagaaaaaatacaaaaattaaccaggcatggtggtatgcacctgtattccgagctactcaggaggctgaggtgtgaggatcacttgagcccaggaggcagaggttgcagtgagccgagattgcatcactgcactccagcttgggcaacgaagtgagactgtatctgaaacaaaaaa

SEQ ID NO: 66562 - DNA, 639 bp, Homo sapiens
gagttggctgagacaatacatgtgcatcattttggaagagatgctcttaaaaagaagaaagccactacagaatgccacatttgcttaggtctaagacccttctgtggtagtcggtgagggagggaggaaagtaaaaccccaagctgaataggccccccatagtttccgagtgatgcagtaaacaaatctatgatgcttgttgaataatcttccaataattgcagtcattaaaatcatcacacagtctacagtcaccttccttcctttgacacaccagtctttcccttaattgttaatgcatttttggctcagataaacacatagaggccagcttaaaatatatggcccagatacatctaacagcagaaaattagttgtgtaacaaacgtttggactgtgcttaatagactaggggttttcaatttcttcagcagaccctacagaggcaagaaagatttgcatcttctaccactgctaaatagcagtgacgcctctgagatacaaaaaaaaaaaaaaaagaaaaaaaagatgaaagtcccattggcctattgaatcttccttgctctttcatttgcaagggttgggctggaattaggacattatagaacaaatattaaaggaaagcttaacagaaactgt

SEQ ID NO: 66563 - DNA, 527 bp, Homo sapiens
gttgcctcctgcctgttctgatttccactgtgtgaaggaagcccgtgaccttggctgaagcagcctgtgctgtaccagctggttggtccgtgtcttcctgctgtggcaaataggaagagtaccaccatcatctgggccagtggtctggtttttatttttattagcaacaaatgcccttaagaagcagctgaacatgctggctaattagagccagaaagaacagcttagcagcaagtgcactaaaatggaaattgcacttggcctccactcagcgtgtgcaagtggtcagcactaaatagcgccatctactaggtctgtccctccggctacttgggagacactccacagccagctcctcctggcaggctgactgggatgccattctcctggaagccggggatcctgcaggggccaaacccacatggtttagtggccgaggcaggcacttgatagcctctgccctgacgacattcctgccactgcagaagggcctcttccgagctctgtggagcagagcctggggcttg

SEQ ID NO: 66564 - DNA, 463 bp, Homo sapiens
aaagtccagttacatttaaatttcagataaacaataaatacttttttagaatagatagttagatgtcccatgaaacatttgggacatatttatactaaaaattattttttgtatatttcagaatagctacaagagaggacttgaaatgttcctaacaaatagaaatgataaatattcaaggtgacagatatcctaaatacccttacttgatcatggcacattctgtgcatgtaacaaaatgtcatatgtacccaataaatatgtataaatattatgtatcaataaaatatttttaaaataattatttttaacggaaacaaattattttatctagcaattatacccctccccccccacacacaactcccatttagctttttaataccttactattacatgcagaaaaccaagaatcacagaacattttttcagcatccgataggaaagacagaggccaaacaaa

SEQ ID NO: 66565 - DNA, 542 bp, Homo sapiens
gcaacctaaatgtccatcgacagatgaataaatcaacaaaatgtggaatagtcatacaatgaatatcagccttaaaaggatggaaattctgacacattttacaacatcgataaaacttgaggagcttatagtaagtgaaacaggccagatacaaaaagacaaatagtgatagttcccctcagatgaggcacctagaatagtcaaatccacagagacagaaaggagaatggaggtttccaggggcaggagagagaatgaggcgttagtgtttagtgggtgcagattttcagctggggaagatgaagaggttccaggggtagccgcacaacagtgtgaatatactttaaaatggctaagatggcaaattctatgttaggtatttttttaaacacagtaataaaaaaaaaaaagcatctagtttagggatttggcaagaccaatacccaagagccaggtttctcccactccctgcaccctccctaaattctcaggcccacctgatggaaaacaagcctccctgcgcctgtgctctccacaagaca

SEQ ID NO: 66566 - DNA, 420 bp, Homo sapiens
gagatgaggtcttgctatgttgcccaagctggtcatgaactcctagcttcaagtgattctcccaccttggcctccaaagggctgggattacaggcatgagcaccgtgcccagcctattgtgtggtcttttgtgactggcttctttcacttagcatcgttttcgaggttcatgcatattgcaggatgtaccagaacttcactcccttttattgctgaataacattccattgcatggacacagcactaatatttggtatatttgaagtttgtacagcttgtgtaggatgaagctccttctctgttcctcacatcaccacaaccccagtgtgtgcatttgggaggtcagtggaatggccacacccacccagaagagacttcttggctaagcaggggaggcgtggatgatgccaccttcttttt

SEQ ID NO: 66567 - DNA, 196 bp, Homo sapiens
ggttgaaattatgcagccttctcaaactggcttctctcatttaggaatatccacctgaggttcctccgtgttttttcatggcttgatggctcatttcttttcagcactgagcactattccagtgtgtggctgtgccacagtttattttatccactcacctactgaagcacatcgtggctgcttgcaagttttggca

SEQ ID NO: 66568 - DNA, 197 bp, Homo sapiens
acagaacgtggcctctgactggaaaccctcgaagcttcccgctacttctcctccccttttggaatcatctagaaagcgggtggatatacagttccagagttcaagagcgagctctcggctgaagatcgaggtctgagagtcactgtctggggttcttcgccagagctgggtcgtggagagcctcaagtgcaatagtg

SEQ ID NO: 66569 - DNA, 795 bp, Homo sapiens
atcccagctactcgggaggctgaggcaggagaatcacttgaaccggggaggcagaggttgcagtgagccgagatcgcgcccctgcactccagcctgggtgacagagcaagactccatctcaaaaaaaataaaggaaatatgcgtcgttggatgctgtatgacaatcaagctacttataacaaacaaaattgagaatgaaggattatgatccaaactcagctgggcctcccctccctgccccaggattgtggagtgagaacgttgcagcaggagagaacaacgcagcaaagcacagcaggggaaccggaaatgctcaccttttgacagggtacttttagttctggggccttatcttaaggatattccaacatatacaaaaagattcatgcacagagatatttactttagtattatttaccataggaaaaaagttggaaacaatacattttatgttctgtaaaatgaaagaacagttaaataaatcatggctctaagacgactccagggctgtgtacggaagttcagggacagaatcagttgaggctgttccacctgagcctaagcttcctctgctgtatgtcgggaatcaggtgggggccaagcgagatcaccacagtgcaggccagtgtgcagggcacaggtgggcgccagggaggggacgccgcacagccccatgctctcgccaaaaacgtgcagcacaatttggaagaaaacatttccatcttcagggtcgtctgtgtctgttaaagtcgagtctagtttcgggtctcagagcacctccctaaagctgccgta

SEQ ID NO: 66570 - DNA, 1260 bp, Homo sapiens
gacggcagaggagccagtcatcatccccaaagacacagctccgaatacctcatcctgaaatcccaaagatcaaaatcccaaaagtataaatctggaaaaaataatgtcgatgttatttatttacatttttaaaaggtatgtatttgagaaacataaaaacacaacagaacatttcataggccactttacacaataaaataggcaatgataacaggtatttttgcataaacactgacgtaactaacgacggcggcatgggtgtagcagttataagaagacagaccataaagaaataagtcaaaagagaaacgcgtacacgtatatcgctacggttactaattgtgtgcacctagccctgtagctgtggtcatctgaaatatcagggattttagacttgagggattttgatctttagggatttcaacattccacattatggtgcttgggattgtgtctttcaggattatgatccaaactcagctgggcctcccctccctgccccaggattgtggagtgagaacgttgcagcaggagagaacaacgcagcaaagcacagcaggggaaccggaaatgctcaccttttgacagggtacttttagttctggggccttatcttaaggatattccaacatatacaaaaagattcatgcacagagatatttactttagtattatttaccataggaaaaaagttggaaacaatacattttatgttctgtaaaatgaaagaacagttaaataaatcatggctctaagacgactccagggctgtgtacggaagttcagggacagaatcagttgaggctgttccacctgagcctaagcttcctctgctgtatgtcgggaatcaggtgggggccaagcgagatcaccacagtgcaggccagtgtgcagggcacaggtgggcgccagggaggggacgccgcacagccccatgctctcgccaaaaacgtgcagcacaatttggaagaaaacatttccatctgttaataaagagcaacggcctctggtcataagtgacacatgaccctttgcctgagtctttttaaatttttccatatgttccatattttctacaccaaatgtaagctactttcataatcacaaaaacttaatggaaagaggaggaggaggacgggggtggggagtagtagccatgggttcgagcccttcctctccgcatgacttggataacacggtatattcacacagctatttccccatctatgaacttctgaggtgcttttattagttgatgtc

SEQ ID NO: 66571 - DNA, 934 bp, Homo sapiens
gacggcagaggagccagtcatcatccccaaagacacagctccgaatacctcatcctgaaatcccaaagatcaaaatcccaaaagtataaatctggaaaaaataatgtcgatgttatttatttacatttttaaaaggattatgatccaaactcagctgggcctcccctccctgccccaggattgtggagtgagaacgttgcagcaggagagaacaacgcagcaaagcacagcaggggaaccggaaatgctcaccttttgacagggtacttttagttctggggccttatcttaaggatattccaacatatacaaaaagattcatgcacagagatatttactttagtattatttaccataggaaaaaagttggaaacaatacattttatgttctgtaaaatgaaagaacagttaaataaatcatggctctaagacgactccagggctgtgtacggaagttcagggacagaatcagttgaggctgttccacctgagcctaagcttcctctgctgtatgtcgggaatcaggtgggggccaagcgagatcaccacagtgcaggccagtgtgcagggcacaggtgggcgccagggaggggacgccgcacagccccatgctctcgccaaaaacgtgcagcacaatttggaagaaaacatttccatctgttaataaagagcaacggcctctggtcataagtgacacatgaccctttgcctgagtctttttaaatttttccatatgttccatattttctacaccaaatgtaagctactttcataatcacaaaaacttaatggaaagaggaggaggaggacgggggtggggagtagtagccatgggttcgagcccttcctctccgcatgacttggataacacggtatattcacacagctatttccccatctatgaacttctgaggtgcttttattagttgatgtc

SEQ ID NO: 66572 - DNA, 1037 bp, Homo sapiens
  misc_feature (13)..(13): n is a, c, g, or t
  misc_feature (15)..(15): n is a, c, g, or t
  misc_feature (104)..(104): n is a, c, g, or t
caaaagcaaacanangaggcacacgcgaaacaaaaagtggcacgattggacctttcggcctggtcctgactgctgggtacaacaattatggcaagaggacaaangacaacatcaagagtcagggctcgggggtcctgacaggcccaggatgggtacagacccacacaggaatcccagagtgtgttccacagcaggacacgcctgcgctgaaagagtggacagaaaggagctgacctgggattatgatccaaactcagctgggcctcccctccctgccccaggattgtggagtgagaacgttgcagcaggagagaacaacgcagcaaagcacagcaggggaaccggaaatgctcaccttttgacagggtacttttagttctggggccttatcttaaggatattccaacatatacaaaaagattcatgcacagagatatttactttagtattatttaccataggaaaaaagttggaaacaatacattttatgttctgtaaaatgaaagaacagttaaataaatcatggctctaagacgactccagggctgtgtacggaagttcagggacagaatcagttgaggctgttccacctgagcctaagcttcctctgctgtatgtcgggaatcaggtgggggccaagcgagatcaccacagtgcaggccagtgtgcagggcacaggtgggcgccagggaggggacgccgcacagccccatgctctcgccaaaaacgtgcagcacaatttggaagaaaacatttccatctgttaataaagagcaacggcctctggtcataagtgacacatgaccctttgcctgagtctttttaaatttttccatatgttccatattttctacaccaaatgtaagctactttcataatcacaaaaacttaatggaaagaggaggaggaggacgggggtggggagtagtagccatgggttcgagcccttcctctccgcatgacttggataacacggtatattcacacagctatttccccatctatgaacttctgaggtgcttttattagttgatgtc

SEQ ID NO: 66573 - DNA, 999 bp, Homo sapiens
atcccagctactcgggaggctgaggcaggagaatcacttgaaccggggaggcagaggttgcagtgagccgagatcgcgcccctgcactccagcctgggtgacagagcaagactccatctcaaaaaaaataaaggaaatatgcgtcgttggatgctgtatgacaatcaagctacttataacaaacaaaattgagaatgaaggattatgatccaaactcagctgggcctcccctccctgccccaggattgtggagtgagaacgttgcagcaggagagaacaacgcagcaaagcacagcaggggaaccggaaatgctcaccttttgacagggtacttttagttctggggccttatcttaaggatattccaacatatacaaaaagattcatgcacagagatatttactttagtattatttaccataggaaaaaagttggaaacaatacattttatgttctgtaaaatgaaagaacagttaaataaatcatggctctaagacgactccagggctgtgtacggaagttcagggacagaatcagttgaggctgttccacctgagcctaagcttcctctgctgtatgtcgggaatcaggtgggggccaagcgagatcaccacagtgcaggccagtgtgcagggcacaggtgggcgccagggaggggacgccgcacagccccatgctctcgccaaaaacgtgcagcacaatttggaagaaaacatttccatctgttaataaagagcaacggcctctggtcataagtgacacatgaccctttgcctgagtctttttaaatttttccatatgttccatattttctacaccaaatgtaagctactttcataatcacaaaaacttaatggaaagaggaggaggaggacgggggtggggagtagtagccatgggttcgagcccttcctctccgcatgacttggataacacggtatattcacacagctatttccccatctatgaacttctgaggtgcttttattagttgatgtc

SEQ ID NO: 66574 - DNA, 3566 bp, Homo sapiens
actccagatataggatcactccatgccatcaagaaagttgatgctattgggcccatctcaagctgatcttggcacctctcatgctctgctctcttcaaccagacctctacattccattttggaagaagactaaaaatggtgtttccaatgtggacactgaagagacaaattcttatcctttttaacataatcctaatttccaaactccttggggctagatggtttcctaaaactctgccctgtgatgtcactctggatgttccaaagaaccatgtgatcgtggactgcacagacaagcatttgacagaaattcctggaggtattcccacgaacaccacgaacctcaccctcaccattaaccacataccagacatctccccagcgtcctttcacagactggaccatctggtagagatcgatttcagatgcaactgtgtacctattccactggggtcaaaaaacaacatgtgcatcaagaggctgcagattaaacccagaagctttagtggactcacttatttaaaatccctttacctggatggaaaccagctactagagataccgcagggcctcccgcctagcttacagcttctcagccttgaggccaacaacatcttttccatcagaaaagagaatctaacagaactggccaacatagaaatactctacctgggccaaaactgttattatcgaaatccttgttatgtttcatattcaatagagaaagatgccttcctaaacttgacaaagttaaaagtgctctccctgaaagataacaatgtcacagccgtccctactgttttgccatctactttaacagaactatatctctacaacaacatgattgcaaaaatccaagaagatgattttaataacctcaaccaattacaaattcttgacctaagtggaaattgccctcgttgttataatgccccatttccttgtgcgccgtgtaaaaataattctcccctacagatccctgtaaatgcttttgatgcgctgacagaattaaaagttttacgtctacacagtaactctcttcagcatgtgcccccaagatggtttaagaacatcaacaaactccaggaactggatctgtcccaaaacttcttggccaaagaaattggggatgctaaatttctgcattttctccccagcctcatccaattggatctgtctttcaattttgaacttcaggtctatcgtgcatctatgaatctatcacaagcattttcttcactgaaaagcctgaaaattctgcggatcagaggatatgtctttaaagagttgaaaagctttaacctctcgccattacataatcttcaaaatcttgaagttcttgatcttggcactaactttataaaaattgctaacctcagcatgtttaaacaatttaaaagactgaaagtcatagatctttcagtgaataaaatatcaccttcaggagattcaagtgaagttggcttctgctcaaatgccagaacttctgtagaaagttatgaaccccaggtcctggaacaattacattatttcagatatgataagtatgcaaggagttgcagattcaaaaacaaagaggcttctttcatgtctgttaatgaaagctgctacaagtatgggcagaccttggatctaagtaaaaatagtatattttttgtcaagtcctctgattttcagcatctttctttcctcaaatgcctgaatctgtcaggaaatctcattagccaaactcttaatggcagtgaattccaacctttagcagagctgagatatttggacttctccaacaaccggcttgatttactccattcaacagcatttgaagagcttcacaaactggaagttctggatataagcagtaatagccattattttcaatcagaaggaattactcatatgctaaactttaccaagaacctaaaggttctgcagaaactgatgatgaacgacaatgacatctcttcctccaccagcaggaccatggagagtgagtctcttagaactctggaattcagaggaaatcacttagatgttttatggagagaaggtgataacagatacttacaattattcaagaatctgctaaaattagaggaattagacatctctaaaaattccctaagtttcttgccttctggagtttttgatggtatgcctccaaatctaaagaatctctctttggccaaaaatgggctcaaatctttcagttggaagaaactccagtgtctaaagaacctggaaactttggacctcagccacaaccaactgaccactgtccctgagagattatccaactgttccagaagcctcaagaatctgattcttaagaataatcaaatcaggagtctgacgaagtattttctacaagatgccttccagttgcgatatctggatctcagctcaaataaaatccagatgatccaaaagaccagcttcccagaaaatgtcctcaacaatctgaagatgttgcttttgcatcataatcggtttctgtgcacctgtgatgctgtgtggtttgtctggtgggttaaccatacggaggtgactattccttacctggccacagatgtgacttgtgtggggccaggagcacacaagggccaaagtgtgatctccctggatctgtacacctgtgagttagatctgactaacctgattctgttctcactttccatatctgtatctctctttctcatggtgatgatgacagcaagtcacctctatttctgggatgtgtggtatatttaccatttctgtaaggccaagataaaggggtatcagcgtctaatatcaccagactgttgctatgatgcttttattgtgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctaaagaacgccctggccacagacaatcatgtggcctatagtcaggtgttcaaggaaacggtctagcccttctttgcaaaacacaactgcctagtttaccaaggagaggcctggctgtttaaattgttttcatatatatcacaccaaaagcgtgttttgaaattcttcaagaaatgagattgcccatatttcaggggagccaccaacgtctgtcacaggagttggaaagatggggtttatataatgcatcaagtcttctttcttatctctctgtgtctctatttgcacttgagtctctcacctcagctcctgtaaaagagtggcaagtaaaaaacatggggctctga

SEQ ID NO: 66575 - DNA, 343 bp, Homo sapiens
actccagatataggatcactccatgccatcaagaaagttgatgctattgggcccatctcaagctgatcttggcacctctcatgctctgctctcttcaaccagacctctacattccattttggaagaagactaaaaatgttaatcttccttctggcatggatcttggaatgcaaacttgctgggatctccgagttccaggcttcccgtgcagccggtgtggagagccaagagatgttttgtttggcataaagcattccaagggtcagtgggcttgggctcaactattgagcataggacaagggcagccccatcctgactgtgactcttcccacaagagacaaac

SEQ ID NO: 66576 - DNA, 5007 bp, Homo sapiens
actccagatataggatcactccatgccatcaagaaagttgatgctattgggcccatctcaagctgatcttggcacctctcatgctctgctctcttcaaccagacctctacattccattttggaagaagactaaaaatggtgtttccaatgtggacactgaagagacaaattcttatcctttttaacataatcctaatttccaaactccttggggctagatggtttcctaaaactctgccctgtgatgtcactctggatgttccaaagaaccatgtgatcgtggactgcacagacaagcatttgacagaaattcctggaggtattcccacgaacaccacgaacctcaccctcaccattaaccacataccagacatctccccagcgtcctttcacagactggaccatctggtagagatcgatttcagatgcaactgtgtacctattccactggggtcaaaaaacaacatgtgcatcaagaggctgcagattaaacccagaagctttagtggactcacttatttaaaatccctttacctggatggaaaccagctactagagataccgcagggcctcccgcctagcttacagcttctcagccttgaggccaacaacatcttttccatcagaaaagagaatctaacagaactggccaacatagaaatactctacctgggccaaaactgttattatcgaaatccttgttatgtttcatattcaatagagaaagatgccttcctaaacttgacaaagttaaaagtgctctccctgaaagataacaatgtcacagccgtccctactgttttgccatctactttaacagaactatatctctacaacaacatgattgcaaaaatccaagaagatgattttaataacctcaaccaattacaaattcttgacctaagtggaaattgccctcgttgttataatgccccatttccttgtgcgccgtgtaaaaataattctcccctacagatccctgtaaatgcttttgatgcgctgacagaattaaaagttttacgtctacacagtaactctcttcagcatgtgcccccaagatggtttaagaacatcaacaaactccaggaactggatctgtcccaaaacttcttggccaaagaaattggggatgctaaatttctgcattttctccccagcctcatccaattggatctgtctttcaattttgaacttcaggtctatcgtgcatctatgaatctatcacaagcattttcttcactgaaaagcctgaaaattctgcggatcagaggatatgtctttaaagagttgaaaagctttaacctctcgccattacataatcttcaaaatcttgaagttcttgatcttggcactaactttataaaaattgctaacctcagcatgtttaaacaatttaaaagactgaaagtcatagatctttcagtgaataaaatatcaccttcaggagattcaagtgaagttggcttctgctcaaatgccagaacttctgtagaaagttatgaaccccaggtcctggaacaattacattatttcagatatgataagtatgcaaggagttgcagattcaaaaacaaagaggcttctttcatgtctgttaatgaaagctgctacaagtatgggcagaccttggatctaagtaaaaatagtatattttttgtcaagtcctctgattttcagcatctttctttcctcaaatgcctgaatctgtcaggaaatctcattagccaaactcttaatggcagtgaattccaacctttagcagagctgagatatttggacttctccaacaaccggcttgatttactccattcaacagcatttgaagagcttcacaaactggaagttctggatataagcagtaatagccattattttcaatcagaaggaattactcatatgctaaactttaccaagaacctaaaggttctgcagaaactgatgatgaacgacaatgacatctcttcctccaccagcaggaccatggagagtgagtctcttagaactctggaattcagaggaaatcacttagatgttttatggagagaaggtgataacagatacttacaattattcaagaatctgctaaaattagaggaattagacatctctaaaaattccctaagtttcttgccttctggagtttttgatggtatgcctccaaatctaaagaatctctctttggccaaaaatgggctcaaatctttcagttggaagaaactccagtgtctaaagaacctggaaactttggacctcagccacaaccaactgaccactgtccctgagagattatccaactgttccagaagcctcaagaatctgattcttaagaataatcaaatcaggagtctgacgaagtattttctacaagatgccttccagttgcgatatctggatctcagctcaaataaaatccagatgatccaaaagaccagcttcccagaaaatgtcctcaacaatctgaagatgttgcttttgcatcataatcggtttctgtgcacctgtgatgctgtgtggtttgtctggtgggttaaccatacggaggtgactattccttacctggccacagatgtgacttgtgtggggccaggagcacacaagggccaaagtgtgatctccctggatctgtacacctgtgagttagatctgactaacctgattctgttctcactttccatatctgtatctctctttctcatggtgatgatgacagcaagtcacctctatttctgggatgtgtggtatatttaccatttctgtaaggccaagataaaggggtatcagcgtctaatatcaccagactgttgctatgatgcttttattgtgtatgacactaaagacccagctgtgaccgagtgggttttggctgagctggtggccaaactggaagacccaagagagaaacattttaatttatgtctcgaggaaagggactggttaccagggcagccagttctggaaaacctttcccagagcatacagcttagcaaaaagacagtgtttgtgatgacagacaagtatgcaaagactgaaaattttaagatagcattttacttgtcccatcagaggctcatggatgaaaaagttgatgtgattatcttgatatttcttgagaagccctttcagaagtccaagttcctccagctccggaaaaggctctgtgggagttctgtccttgagtggccaacaaacccgcaagctcacccatacttctggcagtgtctaaagaacgccctggccacagacaatcatgtggcctatagtcaggtgttcaaggaaacggtctagcccttctttgcaaaacacaactgcctagtttaccaaggagaggcctggctgtttaaattgttttcatatatatcacaccaaaagcgtgttttgaaattcttcaagaaatgagattgcccatatttcaggggagccaccaacgtctgtcacaggagttggaaagatggggtttatataatgcatcaagtcttctttcttatctctctgtgtctctatttgcacttgagtctctcacctcagctcctgtaaaagagtggcaagtaaaaaacatggggctctgattctcctgtaattgtgataattaaatatacacacaatcatgacattgagaagaactgcatttctacccttaaaaagtactggtatatacagaaatagggttaaaaaaaactcaagctctctctatatgagaccaaaatgtactagagttagtttagtgaaataaaaaaccagtcagctggccgggcatggtggctcatgcttgtaatcccagcactttgggaggccgaggcaggtggatcacgaggtcaggagtttgagaccagtctggccaacatggtgaaaccccgtctgtactaaaaatacaaaaattagctgggcgtggtggtgggtgcctgtaatcccagctacttgggaggctgaggcaggagaatcgcttgaacccgggaggtggaggtggcagtgagccgagatcacgccactgcaatgcagcccgggcaacagagctagactgtctcaaaagaacaaaaaaaaaaaaacacaaaaaaactcagtcagcttcttaaccaattgcttccgtgtcatccagggccccattctgtgcagattgagtgtgggcaccacacaggtggttgctgcttcagtgcttcctgctctttttccttgggcctgcttctgggttccatagggaaacagtaagaaagaaagacacatccttaccataaatgcatatggtccacctacaaatagaaaaatatttaaatgatctgcctttatacaaagtgatattctctacctttgataatttacctgcttaaatgtttttatctgcactgcaaagtactgtatccaaagtaaaatttcctcatccaatatctttcaaactgttttgttaactaatgccatatatttgtaagtatctgcacacttgatacagcaacgttagatggttttgatggtaaaccctaaaggaggactccaagagtgtgtatttatttatagttttatcagagatgacaattatttgaatgccaattatatggattcctttcattttttgctggaggatgggagaagaaaccaaagtttatagaccttcacattgagaaagcttcagttttgaacttcagctatcagattcaaaaacaacagaaagaaccaagacattcttaagatgcctgtactttcagctgggtataaattcatgagttcaaagattgaaacctgaccaatttgctttatttcatggaagaagtgatctacaaaggtgtttgtgccatttggaaaacagcgtgcatgtgttcaagccttagattggcgatgtcgtattttcctcacgtgtggcaatgccaaaggctttactttacctgtgagtacacactatatgaattatttccaacgtacatttaatcaataagggtcacaaattcccaaatcaatctctggaataaatagagaggtaattaaattgctggagccaactatttcacaacttctgtaagc

SEQ ID NO: 66577 - DNA, 472 bp, Homo sapiens
ggtcgacctggaaaggcacagcaggtttggttttgaaatctgtagaattttagtgctctccattctcccaagtagatgactttagtgaaggtaaaaggaaagactgtttgctgtgtcaagggaagattcatatgcaaatcccaagactcagatgttatttcagaagagttggtgtccatagtaaagtagaactggcccgggttcatctgcctacaagggcaattgtctgaggcaaatatgaggagactggcagaacaggaggggtggaatcttcctgggagaaagagtaaagagagttctaggtggagaggggatcaatatgttgagcaaacacctggctgtcttcttagttcctatatgaaatcatggaaaagactttagaacaaagaataaatatgtcatagcaggaaaacaaagagcagtcttttggccagaaatagaaactgttaaaaagaaaaacaaaccaacaaca

SEQ ID NO: 66578 - DNA, 233 bp, Homo sapiens
ttgtactctgccttacaatcctctgtgagtggctgttccatttcctgaatagcgtgtgcatgtgtgtgtttgtatttgtgagggtggttaaagtaacaagtgttttattatttggtttataaatatttggtgagcccttagtatgcttgaggttatgatagagaaataaaatatctaagacaatatgtcatggttgaaggtgttgaaaattttgtggtttaaatacatggatg

SEQ ID NO: 66579 - DNA, 823 bp, Homo sapiens
aaactactcaatgatgtatttaatacataacattacctaatattgccaatagtaaagaacaatttacaggtttatgtttcagcttacagtaatgttcccaaagatcttttaatagggtcttagctgtgtgtgtcagtgatgtgtgtatgtttgcgagtgtgtatgtgtgtaattcctaggtatgtatggaataatgttttgagaaattcagataaatttatgatatctaaacaatttgttttattaatggatcttatcacaaattcagctcttattaaactagcaattaacttgcacactagaacacatttttcagtaaatccataacaaacttattaattagaattaggtttgagttatgcatatggttaaaaatatcttttctatgttggtgtaaactttttcgaatgtatttctagtttttttttaaaaaaagattaaattcaaaatgatcttgcaattctgcttcatgagatagaatagaaacatctttgaatgccaggtttctcaacggaggcttgtgtaagctcttctaaaagttaaatatctggttatttacaaatacaaagttatgtatattcattactgatttgtttcataccttactttttgaattggaatgattcagagtataattcttacagagagcccatcacatagtagtcaacgttctaagttttttatgcatattagttcattcagtcctcacagcagccatcatcactgtgtgattcttgaagctctggaaatctaggatttctatatagtacaccaacataccagtttacatatattataggaaaggtaaacgaaacaaacaaac

SEQ ID NO: 66580 - DNA, 617 bp, Homo sapiens
cacgtctacttacctacctgcatctacactcttgatattctgatgaccctcccattaaaatggatgaactgcatgtccatttatcttaagccaacacctctacttatgtactagatcccattctttcttctcccctttctctcttgtattagcaacatttccttcttttactgtaccgtataaagatgctatattttctcccatctttaaaaaagaaaaagtctcttttaaccctatatctccctccagctactaactgtatttctctcttgtgctttaaagaaaaaaaaatgtgtgtgtgtgtgttttctttttgtttgttttgtttgtttgtttttggtatggtcttaacggtcttgctttgtcacccagggtggagtgcagttgtgtgattgtggctcactgcagcctcagtctcctgggttcaccgggctcaagtgatcctctcacctcagctcctgaataccttggaatacaggcatgtgctgccatgcctggctagagaaaacgttcttgaaaacgtttcatatacttaatatttttaattccttgccttccattctttcttgaatccactccaatcagatttttattcttgccattcttctaaaactact

SEQ ID NO: 66581 - DNA, 365 bp, Homo sapiens
cagaacagcatgtgatggcagagagatcggagtgatttaaccaaggaattccaagacctgctagccaccattagaagccagatgtcggcaagaaatcattctttttcaaagtcttaaagagagagcaaagttctgctgacactttgatttcagacttctagccttcataacatgttttacttctggtgtagacaagaatcacagaagatttgcgtggaagagccagcaaagatcccttcaaaccactgtcaaggatttctgcttcaactaattagggaacaaaggctaagaattacttaaaagtcacagaccaaggacacagatccactgaaagatagagatttcatcgtaagattagagaaggc

SEQ ID NO: 66582 - DNA, 443 bp, Homo sapiens
caccttttcatatgcttatttaccatctgtatatcttctttggtgaggtgtccataaaggcctttggcttgtttgtttaattgggttttgttttcttattgttaaattttgggaattcttggtgtattttagacactagtcctttacctgataggccttttgaaaatattttcttccatttcatggcttgccttttcattcttctacagagcagaagtttttaattttaataaaatccagcttattgatttcctgttttatggattgtgactttggtattgtatcttaaaagtcaccaccaaacccaaggccagctagattttatagtttcaaattttacctttaagtctgtgatccgttttaagttaatttttgtgaaggaagtaaggtctgtgtcttgattcattttttatttttttgcctgcagatgtacagttgcttct

SEQ ID NO: 66583 - DNA, 451 bp, Homo sapiens
gtaagaatgcaattacgccccatcccatcccgtgactccattcccagaaggtcctgggactagaggcttctcaatgaactagatgcttccaaaaagcagagcagcgttcaagatgccccctgcccaccccacaataggtgaggcacacactctcagccaacaaatgtgagtgtgtgcctgctgtactgtgcttgtgttctggcagactcaaagacatctaagatgcagtccaggccaggtgcagtggctcacgcttgcaatcccaacactttgggagaccgagttgggcggatcacttgagattaggagttcgagaccagcctggccaacatggtgaaactacatctctactaaaaatacaaaaattagctgggcgtggtggcgggcgcctgtaatcccagctacttgggaagctgaggcaggagaattgcttgaacccaggaggtggagg

SEQ ID NO: 66584 - DNA, 445 bp, Homo sapiens
gaaatagtaatgtggaggaaagtctcagtaatttttattcatttggtcgatgacttctcacaaaatgatataaaatatgactttagacttcagcaaaagcacctggatcatagacactcaataaactgtagcagggtcattagaggtaattggatctatttgagccagaaaaagactgtgctgttttactcgaggcatttaaaattaaagctagaaccttatttgtatgaaatagcttgagtgtgggtatgcataacagctgcaacttctcaagactattacagttctatagtaagaattttcaatattcaaacagtaaacaataaactgaaaaaaagatatagatactctaacctgtaacactttatttatataattagacatctccaaattaatcaactaattttagttgcataaaataataaagctgctaaaattttgtatt

SEQ ID NO: 66585 - DNA, 749 bp, Homo sapiens
tgtccaaggctgcggtgtttcttagtggagaggctgtcagcatttgggcaggaaaattcttcatctcacaggatgtttagcacccctggctgctgcccatagctaccagtagagccccagtcattatgagaacccccaaaattctcccacgccttcctaaattcccctagggaagacagcaccttccccagctgggaataaaaaggttcaaaaaccactgatctcatccagccttcttactttagagacgaagaaactgtggcctagagagggcatgcgatttgtcccaggtcacacagtgagctggagacagagcgggcctaggcccaggtctcttgactttccttttactccagcatttccccatcttcatcgcgaaaaatcacccgggatgcagaaagcttgctgaaatacagacgcccaggccagttccctgggattccactttaggaggcccaggaatctgtgtttagtgcttttcatcccttacttatggtgtgcagaatcccctggggatcttgtgaaaatgccaagaatctgcatttctgcatttctacctggcatcgaggtgatgctgacgctctggtctagggacactaccctttgaataggggaaagtctgctttcaccctgcgagcccctgggtgaacccatatggtcagggcagttagggcattgcttcatcctgggggttggaatggggagtggtcaactgtgtctgcagattagacttacgtgaagagctaaaa

SEQ ID NO: 66586 - DNA, 368 bp, Homo sapiens
ctgggattacaggcatgcgccaccatgcccggctaattttgtatttttaatagagatggggtttctccacgttggctaggctggtctcgaactcctgacctcaggtgatccgcctgccttggcctcctaaagtgctgggattacaggcgtgagccacggcgcccatttgtctttttttcaaacacgttgctattgcttagtcacggctgccttactctgttttggggggagtgtgtctgtgtgtgtgtgtgtctcttctccatgtgcacacacttttttaccgtaagccaaattttggtaaaattgcatcttgtattttcttattactaaattacttgcctagaagtaatcttcaatctttttagaaa

SEQ ID NO: 66587 - DNA, 1244 bp, Homo sapiens
  misc_feature (3)..(3): n is a, c, g, or t
  misc_feature (5)..(6): n is a, c, g, or t
ggnannagggtgagccacggcgcccggcatccaggctagtcttgaactcctgacctcaagtgatccgtccgcctgggcctcccaaggtgctgggattacaggcgtgagccaccgcgcccggccaggttgtgggttttaatgggaccatctcactgcctaccgtttcctttttccgtccgaacagaaggggcctgagcagtgaactgacagtggcaacgccgggtgaggcgggatggaggagtttacgagcctgggtgacgccctgttccgcgtcctggccccgcccctcccggcagagccccttggcgcgtgacacaggccccgcccttgctgtacgccatcagccggcgccgcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggaggtattgctggatgctgtgccaaaacaacagttgctccattggatcgagtaaaggttttattacaagactccatctcaaaaaaaaaaaaaaaaaaaaaagatacctcagttaggttatcagtaaaaggggattgcaaatatcttttaaataaaaatttgcattctatatgttatagaatacagaggatattaaaaataaattttatccatgttttgacaatttctttctttcaactgtttacatattgaagcacaaatgctaaacataagtcagaatggaagaatatttaaaataatgactgtgtttatatctgatttatttcagattgcccaaagtgcatcttgccaggttatcttccatttgaagactgacattttatttcttttttgatctttattgttcctctcttccacctctcagtgggtatagctctctggtctgtagaatgggacagtggtctggtttccagattgataagtgaggtatacctcctagttttcagtaattacctgtagaaggtggagaagttactggatatgtttaataatatctcattacattcttttttttttttttttaacgagagtcttaactctgtcacccaagctggagtgcagtggtgcaatctcggctc

SEQ ID NO: 66588 - DNA, 597 bp, Homo sapiens
ctgcattctaacctgggcgacagagcaagactccatctcaaaaaaaaaaaaaaaaaaaaaagatacctcagttaggttatcagtaaaaggggattgcaaatatcttttaaataaaaatttgcattctatatgttatagaatacagaggatattaaaaataaattttatccatgttttgacaatttctttctttcaactgtttacatattgaagcacaaatgctaaacataagtcagaatggaagaatatttaaaataatgactgtgtttatatctgatttatttcagattgcccaaagtgcatcttgccaggttatcttccatttgaagactgacattttatttcttttttgatctttattgttcctctcttccacctctcagtgggtatagctctctggtctgtagaatgggacagtggtctggtttccagattgataagtgaggtatacctcctagttttcagtaattacctgtagaaggtggagaagttactggatatgtttaataatatctcattacattcttttttttttttttttaacgagagtcttaactctgtcacccaagctggagtgcagtggtgcaatctcggctc

SEQ ID NO: 66589 - DNA, 2684 bp, Homo sapiens
  misc_feature (3)..(3): n is a, c, g, or t
  misc_feature (5)..(6): n is a, c, g, or t
ggnannagggtgagccacggcgcccggcatccaggctagtcttgaactcctgacctcaagtgatccgtccgcctgggcctcccaaggtgctgggattacaggcgtgagccaccgcgcccggccaggttgtgggttttaatgggaccatctcactgcctaccgtttcctttttccgtccgaacagaaggggcctgagcagtgaactgacagtggcaacgccgggtgaggcgggatggaggagtttacgagcctgggtgacgccctgttccgcgtcctggccccgcccctcccggcagagccccttggcgcgtgacacaggccccgcccttgctgtacgccatcagccggcgccgcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgccttaccatgcgggatactatgaagtatgtctatggacaccatggaattcgaaaaggactctatcgtggtttatctcttaattacattcgctgtattccctctcaagcagtggcttttacaacatacgaacttatgaagcagttttttcacctcaactaaaaaaaaattatggttggtttttcttaatacattctcagagggagaaatgaaacattactataattgtggggggaacattacttgaatggggatatttaccctgtcacaagagccactggtattttagtacttgattattttttctttagtcacaaatcagaactgcttaccatactttttgatgccaaacattataccttagaacattgaagaaaatattcctaagctgatgctggctaaaccgctttaaagttttatttggaagtagaactagctttaaaacggggttcaagaggttgccattagctttgtcatgctgttcaaagtttttaattgttatcatggtttttaaaagactgacagtgtttattattattaaaataaacagggttggttatattgcaatagaataatgagaattgaatttttaagttctatgaaacagccagcattgacattttatttttgttatctctcttctcacaattatgctccactggataataggaaaaacacttctttccttcattttttaaataaaattaatgttgtatttaaaaagtagccatgtagagacacaaaaataaatgaagaagctggacatggtgggatgggcatgtggtcccagctactctggaagctgaggtgagaggatcacttgagccctggaattccatgccagcctatgcaacatcatgaaaccccacttaataaatgaatgaacgactaagtcttgctcaaatgttattatgaggtactatgagtgacttacatgtgttttaaaatgtcagtgtgtttcccagaggcagaaataaaaatactgaatatctttgctcttaaaaaaaaagtaacactatagatttgtttttgttagatgatttgctctatagtagaatatttaagtagactgtgaaatatttattaatatagatgtgaatatcaaaaaatgtttctaaggtattatgatgcatcaactagttcttccatgtaaaataattttagtgcaatatgaagacgtagaaatgtaaaatatgatttgaattgttatcctttatattaagaaaatgttttaaaatgtaagaattccatttattctgtttagagtactttttatgatttattataagcgtgtcataaatgggaagggaatatttaaagttctgtgttcagaaagagtaatttgtagaactgatgtgacttttttt

SEQ ID NO: 66590 - DNA, 2318 bp, Homo sapiens
  misc_feature (3)..(3): n is a, c, g, or t
  misc_feature (5)..(6): n is a, c, g, or t
ggnannagggtgagccacggcgcccggcatccaggctagtcttgaactcctgacctcaagtgatccgtccgcctgggcctcccaaggtgctgggattacaggcgtgagccaccgcgcccggccaggttgtgggttttaatgggaccatctcactgcctaccgtttcctttttccgtccgaacagaaggggcctgagcagtgaactgacagtggcaacgccgggtgaggcgggatggaggagtttacgagcctgggtgacgccctgttccgcgtcctggccccgcccctcccggcagagccccttggcgcgtgacacaggccccgcccttgctgtacgccatcagccggcgccgcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgccttaccatgcgggatactatgaagtatgtctatggacaccatggaattcgaaaaggactctatcgtggtttatctcttaattacattcgctgtattccctctcaagcagtggcttttacaacatacgaacttatgaagcagttttttcacctcaactaaaaaaaaattatggttggtttttcttaatacattctcagagggagaaatgaaacattactataattgtggggggaacattacttgaatggggatatttaccctgtcacaagagccactggtattttagtacttgattattttttctttagtcacaaatcagaactgcttaccatactttttgatgccaaacattataccttagaacattgaagaaaatattcctaagctgatgctggctaaaccgctttaaagttttatttggaagtagaactagctttaaaacggggttcaagaggttgccattagctttgtcatgctgttcaaagtttttaattgttatcatggtttttaaaagactgacagtgtttattattattaaaataaacagggttggttatattgcaatagaataatgagaattgaatttttaagttctatgaaacagccagcattgacattttatttttgttatctctcttctcacaattatgctccactggataataggaaaaacacttctttccttcattttttaaataaaattaatgttgtatttaaaaagtagccatgtagagacacaaaaataaatgaagaagctggacatggtgggatgggcatgtggtcccagctactctggaagctgaggtgagaggatcacttgagccctggaattccatgccagcctatgcaacatcatgaaaccccacttaataaatgaatgaacgactaagtcttgctcaaatgttattatgaggtactatgagtgacttacatgtgttttaaaatgtcagtgtgtttcccagaggcagaaataaaaatactgaatatctttgctctta

SEQ ID NO: 66591 - DNA, 2333 bp, Homo sapiens
tacatatttgctgaatgtataaatggatgactaattttatgggtaaaagttggttgtttcaatgaaaaatgatccagaagaagaggagtttacttcaaacagaacctggcaatcggataaataccttcaagtgtctgtctccgtaaaaatgttccagaagaagaggaggttacttcaaacagaacctggcagttggattaataccttgaagtgtctgtctccataaccacattttagcaagattcccagccttcctcaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgccttaccatgcgggatactatgaagtatgtctatggacaccatggaattcgaaaaggactctatcgtggtttatctcttaattacattcgctgtattccctctcaagcagtggcttttacaacatacgaacttatgaagcagttttttcacctcaactaaaaaaaaattatggttggtttttcttaatacattctcagagggagaaatgaaacattactataattgtggggggaacattacttgaatggggatatttaccctgtcacaagagccactggtattttagtacttgattattttttctttagtcacaaatcagaactgcttaccatactttttgatgccaaacattataccttagaacattgaagaaaatattcctaagctgatgctggctaaaccgctttaaagttttatttggaagtagaactagctttaaaacggggttcaagaggttgccattagctttgtcatgctgttcaaagtttttaattgttatcatggtttttaaaagactgacagtgtttattattattaaaataaacagggttggttatattgcaatagaataatgagaattgaatttttaagttctatgaaacagccagcattgacattttatttttgttatctctcttctcacaattatgctccactggataataggaaaaacacttctttccttcattttttaaataaaattaatgttgtatttaaaaagtagccatgtagagacacaaaaataaatgaagaagctggacatggtgggatgggcatgtggtcccagctactctggaagctgaggtgagaggatcacttgagccctggaattccatgccagcctatgcaacatcatgaaaccccacttaataaatgaatgaacgactaagtcttgctcaaatgttattatgaggtactatgagtgacttacatgtgttttaaaatgtcagtgtgtttcccagaggcagaaataaaaatactgaatatctttgctcttaaaaaaaaagtaacactatagatttgtttttgttagatgatttgctctatagtagaatatttaagtagactgtgaaatatttattaatatagatgtgaatatcaaaaaatgtttctaaggtattatgatgcatcaactagttcttccatgtaaaataattttagtgcaatatgaagacgtagaaatgtaaaatatgatttgaattgttatcctttatattaagaaaatgttttaaaatgtaagaattccatttattctgtttagagtactttttatgatttattataagcgtgtcataaatgggaagggaatatttaaagttctgtgttcagaaagagtaatttgtagaactgatgtgacttttttt

SEQ ID NO: 66592 - DNA, 1398 bp, Homo sapiens
  misc_feature (3)..(3): n is a, c, g, or t
  misc_feature (5)..(6): n is a, c, g, or t
ggnannagggtgagccacggcgcccggcatccaggctagtcttgaactcctgacctcaagtgatccgtccgcctgggcctcccaaggtgctgggattacaggcgtgagccaccgcgcccggccaggttgtgggttttaatgggaccatctcactgcctaccgtttcctttttccgtccgaacagaaggggcctgagcagtgaactgacagtggcaacgccgggtgaggcgggatggaggagtttacgagcctgggtgacgccctgttccgcgtcctggccccgcccctcccggcagagccccttggcgcgtgacacaggccccgcccttgctgtacgccatcagccggcgccgcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgcctgtaagttcatcatatgtcattgttcattttctttaggaaatgtaacattaaactcagtaaggagataggaaaaaaa

SEQ ID NO: 66593 - DNA, 811 bp, Homo sapiens
gtcatacatccacagaagctggtattacagaagagatggttttacaccatgttggctaggctggtctcgaactcctgacctcagatgatctgcccacctcggcctcccaaagtgctgggaatacagaagaagaggaggttacttcaaacagaacctggcagttggattaataccttgaagtgtctgtctccataaccacattttagcaagattcccagccttcctcaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtaaacatattctactatttgtattggattgtagttgtaaactgagggaagaagaaagctgttaccaccactattcaaggtaagcagtttctgattgccttattgtacatcgagggcttttttggccttcttaaaagaagtgttaggtagaatagtaaggagtgtgtgaatggagaaaagaggcccaatgggagactgtagcttcatgaattgaaaacctcagtcaccctctgaatgattgttatggatgtcagtctgattactagcagcaggcaagctgaattcccacgtt

SEQ ID NO: 66594 - DNA, 2343 bp, Homo sapiens
  misc_feature (3)..(3): n is a, c, g, or t
  misc_feature (5)..(6): n is a, c, g, or t
ggnannagggtgagccacggcgcccggcatccaggctagtcttgaactcctgacctcaagtgatccgtccgcctgggcctcccaaggtgctgggattacaggcgtgagccaccgcgcccggccaggttgtgggttttaatgggaccatctcactgcctaccgtttcctttttccgtccgaacagaaggggcctgagcagtgaactgacagtggcaacgccgggtgaggcgggatggaggagtttacgagcctgggtgacgccctgttccgcgtcctggccccgcccctcccggcagagccccttggcgcgtgacacaggccccgcccttgctgtacgccatcagccggcgccgcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggaggtgtgggtccatgccacgaagagccagccgcgctctgagtggcgggggcaggactgtgggcaagtgggatgcaagcggcctctatgacattcctggactctggctgcttcaatgttctgttagatgtctgccctgacctgctgtaacctctttctagtaatcacttgactaatgacagctaggttatggggagtgggacctttggcactccggcagaggctggggaggtggaaggtctgaatcaggcacccattcttcagggctggataacagggaaaagaggaggatcccttacagagaccctggggttttatgtagacttggattttgctgtttgcttaaaggaaaacaaatattggagatcagctttttaatgactactggaaaattgtgcaaactgtctacagccaaaactggttccagtgattctagtaaactgtgacacagtacttgacaagccctattattgatgtgactttgggatcaaaaagttcatattgtctcttaggaatttcctgggccttcaagctccacccttccttaattacttctctgggttgtgtaggggtgggttgcccctccacacctgtgggtgtttctcgtaaggtggaacgagagacttaggaaagaaaaagacacagagacaaagtatagagacagaaataaggggacccggggaaccagcgttcagcatatggaggatcccgccagcctctgagttcccttagtatttattgatcatttgtgggtgtttctcgaagagggggatgtgtcagggtcacaagacaattgtggggagagggtcagcagacaaacacgtgaacaaaggtctttgcgtcatagacaatgtaaaggattaagtgctgtgctcttagatatgcatacacataaacatctcaatgctttacaaagcagtattgctgcccgcaggtcccacctccagccctaaggcggtttttccctatctcagtagatggagcatacaatcgcgttttataccgagacattccattgcccagggacaggcaggagacagatgccttcctcttgtctcaactgcaagaggcatgccttcctcttatactaatcctcctcagcacagaccctttacgggtgtcgggctgggggacgttcaggtctttcccttcccacgaggccgtatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcttgcaccgcccttaatccattcaactctgtgacacagcacatgtttcagagagcacggggttgggggtaaggttatagattaacagaatctcaaggcagaagaatttttcttagtacagaacaaaatggagtctcctatgtctacttctttctacacagacacagtaacaatctgatctctcttgcttttccccacaggttgtcattacttaattatttaagattcaaaaatttaaaaattccacattgaagttgtgtgcagtggctcactactgtagtcccagttactagggaagctgaggcaggaagactgcttgagtccaggagatcgaggctccagtgagccatgatcacaccactaccctccagcctgagctacagagagagaccctctcctaaaagaag

SEQ ID NO: 66595 - DNA, 2791 bp, Homo sapiens
  misc_feature (3)..(3): n is a, c, g, or t
  misc_feature (5)..(6): n is a, c, g, or t
ggnannagggtgagccacggcgcccggcatccaggctagtcttgaactcctgacctcaagtgatccgtccgcctgggcctcccaaggtgctgggattacaggcgtgagccaccgcgcccggccaggttgtgggttttaatgggaccatctcactgcctaccgtttcctttttccgtccgaacagaaggggcctgagcagtgaactgacagtggcaacgccgggtgaggcgggatggaggagtttacgagcctgggtgacgccctgttccgcgtcctggccccgcccctcccggcagagccccttggcgcgtgacacaggccccgcccttgctgtacgccatcagccggcgccgcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggaggtcagaagaagaggaggttacttcaaacagaacctggcagttggattaataccttgaagtgtctgtctccataaccacattttagcaagattcccagccttcctcaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgccttaccatgcgggatactatgaagtatgtctatggacaccatggaattcgaaaaggactctatcgtggtttatctcttaattacattcgctgtattccctctcaagcagtggcttttacaacatacgaacttatgaagcagttttttcacctcaactaaaaaaaaattatggttggtttttcttaatacattctcagagggagaaatgaaacattactataattgtggggggaacattacttgaatggggatatttaccctgtcacaagagccactggtattttagtacttgattattttttctttagtcacaaatcagaactgcttaccatactttttgatgccaaacattataccttagaacattgaagaaaatattcctaagctgatgctggctaaaccgctttaaagttttatttggaagtagaactagctttaaaacggggttcaagaggttgccattagctttgtcatgctgttcaaagtttttaattgttatcatggtttttaaaagactgacagtgtttattattattaaaataaacagggttggttatattgcaatagaataatgagaattgaatttttaagttctatgaaacagccagcattgacattttatttttgttatctctcttctcacaattatgctccactggataataggaaaaacacttctttccttcattttttaaataaaattaatgttgtatttaaaaagtagccatgtagagacacaaaaataaatgaagaagctggacatggtgggatgggcatgtggtcccagctactctggaagctgaggtgagaggatcacttgagccctggaattccatgccagcctatgcaacatcatgaaaccccacttaataaatgaatgaacgactaagtcttgctcaaatgttattatgaggtactatgagtgacttacatgtgttttaaaatgtcagtgtgtttcccagaggcagaaataaaaatactgaatatctttgctcttaaaaaaaaagtaacactatagatttgtttttgttagatgatttgctctatagtagaatatttaagtagactgtgaaatatttattaatatagatgtgaatatcaaaaaatgtttctaaggtattatgatgcatcaactagttcttccatgtaaaataattttagtgcaatatgaagacgtagaaatgtaaaatatgatttgaattgttatcctttatattaagaaaatgttttaaaatgtaagaattccatttattctgtttagagtactttttatgatttattataagcgtgtcataaatgggaagggaatatttaaagttctgtgttcagaaagagtaatttgtagaactgatgtgacttttttt

SEQ ID NO: 66596 - DNA, 2302 bp, Homo sapiens
gtcatacatccacagaagctggtattacagaagagatggttttacaccatgttggctaggctggtctcgaactcctgacctcagatgatctgcccacctcggcctcccaaagtgctgggaatacagaagaagaggaggttacttcaaacagaacctggcagttggattaataccttgaagtgtctgtctccataaccacattttagcaagattcccagccttcctcaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgccttaccatgcgggatactatgaagtatgtctatggacaccatggaattcgaaaaggactctatcgtggtttatctcttaattacattcgctgtattccctctcaagcagtggcttttacaacatacgaacttatgaagcagttttttcacctcaactaaaaaaaaattatggttggtttttcttaatacattctcagagggagaaatgaaacattactataattgtggggggaacattacttgaatggggatatttaccctgtcacaagagccactggtattttagtacttgattattttttctttagtcacaaatcagaactgcttaccatactttttgatgccaaacattataccttagaacattgaagaaaatattcctaagctgatgctggctaaaccgctttaaagttttatttggaagtagaactagctttaaaacggggttcaagaggttgccattagctttgtcatgctgttcaaagtttttaattgttatcatggtttttaaaagactgacagtgtttattattattaaaataaacagggttggttatattgcaatagaataatgagaattgaatttttaagttctatgaaacagccagcattgacattttatttttgttatctctcttctcacaattatgctccactggataataggaaaaacacttctttccttcattttttaaataaaattaatgttgtatttaaaaagtagccatgtagagacacaaaaataaatgaagaagctggacatggtgggatgggcatgtggtcccagctactctggaagctgaggtgagaggatcacttgagccctggaattccatgccagcctatgcaacatcatgaaaccccacttaataaatgaatgaacgactaagtcttgctcaaatgttattatgaggtactatgagtgacttacatgtgttttaaaatgtcagtgtgtttcccagaggcagaaataaaaatactgaatatctttgctcttaaaaaaaaagtaacactatagatttgtttttgttagatgatttgctctatagtagaatatttaagtagactgtgaaatatttattaatatagatgtgaatatcaaaaaatgtttctaaggtattatgatgcatcaactagttcttccatgtaaaataattttagtgcaatatgaagacgtagaaatgtaaaatatgatttgaattgttatcctttatattaagaaaatgttttaaaatgtaagaattccatttattctgtttagagtactttttatgatttattataagcgtgtcataaatgggaagggaatatttaaagttctgtgttcagaaagagtaatttgtagaactgatgtgacttttttt

SEQ ID NO: 66597 - DNA, 2381 bp, Homo sapiens
gtcatacatccacagaagctggtattacagaagagatggttttacaccatgttggctaggctggtctcgaactcctgacctcagatgatctgcccacctcggcctcccaaagtgctgggaatacagaagaagaggaggttacttcaaacagaacctggcagttggattaataccttgaagtgtctgtctccataaccacattttagcaagattcccagccttcctcaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtaaacatattctactatttgtattggattgtagttgtaaactgagggaagaagaaagctgttaccaccactattcaaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattttttacttttggtaccttgaagagtgttgggctttcccatgctcctacccttcttggcagaccttcatcagacaatcctaatgtcttagttttgaaaactcatgtaaacttactttgtggtggtgttgctggagcaatagcgcagacaatatcctacccatttgatgtgactcgtcggcgaatgcaattaggaactgttctgccggaatttgaaaagtgccttaccatgcgggatactatgaagtatgtctatggacaccatggaattcgaaaaggactctatcgtggtttatctcttaattacattcgctgtattccctctcaagcagtggcttttacaacatacgaacttatgaagcagttttttcacctcaactaaaaaaaaattatggttggtttttcttaatacattctcagagggagaaatgaaacattactataattgtggggggaacattacttgaatggggatatttaccctgtcacaagagccactggtattttagtacttgattattttttctttagtcacaaatcagaactgcttaccatactttttgatgccaaacattataccttagaacattgaagaaaatattcctaagctgatgctggctaaaccgctttaaagttttatttggaagtagaactagctttaaaacggggttcaagaggttgccattagctttgtcatgctgttcaaagtttttaattgttatcatggtttttaaaagactgacagtgtttattattattaaaataaacagggttggttatattgcaatagaataatgagaattgaatttttaagttctatgaaacagccagcattgacattttatttttgttatctctcttctcacaattatgctccactggataataggaaaaacacttctttccttcattttttaaataaaattaatgttgtatttaaaaagtagccatgtagagacacaaaaataaatgaagaagctggacatggtgggatgggcatgtggtcccagctactctggaagctgaggtgagaggatcacttgagccctggaattccatgccagcctatgcaacatcatgaaaccccacttaataaatgaatgaacgactaagtcttgctcaaatgttattatgaggtactatgagtgacttacatgtgttttaaaatgtcagtgtgtttcccagaggcagaaataaaaatactgaatatctttgctcttaaaaaaaaagtaacactatagatttgtttttgttagatgatttgctctatagtagaatatttaagtagactgtgaaatatttattaatatagatgtgaatatcaaaaaatgtttctaaggtattatgatgcatcaactagttcttccatgtaaaataattttagtgcaatatgaagacgtagaaatgtaaaatatgatttgaattgttatcctttatattaagaaaatgttttaaaatgtaagaattccatttattctgtttagagtactttttatgatttattataagcgtgtcataaatgggaagggaatatttaaagttctgtgttcagaaagagtaatttgtagaactgatgtgacttttttt

SEQ ID NO: 66598 - DNA, 1150 bp, Homo sapiens
  misc_feature (3)..(3): n is a, c, g, or t
  misc_feature (5)..(6): n is a, c, g, or t
  misc_feature (1101)..(1101): n is a, c, g, or t
  misc_feature (1109)..(1109): n is a, c, g, or t
ggnannagggtgagccacggcgcccggcatccaggctagtcttgaactcctgacctcaagtgatccgtccgcctgggcctcccaaggtgctgggattacaggcgtgagccaccgcgcccggccaggttgtgggttttaatgggaccatctcactgcctaccgtttcctttttccgtccgaacagaaggggcctgagcagtgaactgacagtggcaacgccgggtgaggcgggatggaggagtttacgagcctgggtgacgccctgttccgcgtcctggccccgcccctcccggcagagccccttggcgcgtgacacaggccccgcccttgctgtacgccatcagccggcgccgcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggaggtattgctggatgctgtgccaaaacaacagttgctccattggatcgagtaaaggttttattacaagctcacaatcaccattacaagcatttaggagtattttctgcattgcgtgctgttcctcaaaaagaaggattccttggattgtataaaggaaatggtgcaatgatgattcgaatctttccctatggtgcaatccagtttatggcatttgagcattataaaacgttaattactacgaagctgggaatttcaggtcatgtgcacagattaatggctggatccatggcaggtatgacagcagttatctgtacttaccctcttgacatggttagggtccgcctagcattccaggtgaaaggggaacacagctatacaggaattattcatgctttcaaaacaatttatgcaaaggaaggtggtttctttggattttacagaggtctgatgcctactattttaggaatggctccatatgcaggtgtttcattnttacttcngcaccaatcactagtgataggtgccaaaatttccaatattc

SEQ ID NO: 66599 - DNA, 892 bp, Homo sapiens
tcattatcctgtaatttttttaattaaaaaaagcagctttagttcatctaggagaaaaccgtctccagaatccattgtctacaagtatttgcacttatacagattttatccagagcatatttaaaaaataaagttgattttgattgtttttataaaaacaaacaggaaggtgatgcatgcaggccatttttgaaagtacattaatacatctataattcttgtcactcacaggccactactataaacattttatagtgctgaatttttccagtttttaagtaatatcttttgtattttatcttacaaatttcattgtatttacatgcagaggaaaaggtgtaaaatcattctgtacagaagaatctataaaaaagaatcttcctcctacgccgcacaccccaaaggactttggatacctattagaaaggattttaaaacacatttgaactgaattcatgacaatatctgttctggcatgtttcatcaatcatgacaaatgaccatggccttgtcaatacaataacatggggggagcagccaagtcagagatgaagtatgattatagttatcttaaaaataaggcaattgtgcaggttttgttaagtgaatccagtgataaattttcctaatggtttttcaggcccacctattttacttctattatgtagcatattattacttaaataaaagctaagtctcaagcttggccatactagagaaagcctctgacatacccctgtgctagaatttgacacagcagggcatcgatttttagaagccagtctgaaactcctgataaaatgactaaaatctaaataagcaccaacccaattaatgtggtctagactttctacaacagatattgatccaattatgtggggaaggttttttc

SEQ ID NO: 66600 - DNA, 2312 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66601 - DNA, 2260 bp, Homo sapiens
ctcggctaggtacgagctgggtttcagcgggcggaggcggcgtggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66602 - DNA, 2211 bp, Homo sapiens
ctcggctaggtacgagctgggtttcagcgggcggaggcggcgtggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66603 - DNA, 2666 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagcaaaaaaaaaaaacacacaaacacaacaacaaaacggacagaccgcccaagaatataccaaagagggcaccacaaaaagggaacccagctacaggacacaaggtgccccaacagaaacacaaaaaaacaaggcccgaccaccgcatacaacacacccacacgggcaacatgcgcacacgggaacaccacggcgaaggaaaccccacatcagcaggacggcacacacagtgcgaacacaacacaaggcacacaaccgccccaggaaacacaaacccacaggcgcaaacaggcacaaggcgcaaacactgacagcaacaaacgcccacgcaacaaccaccaacactacgaaccaaaag

SEQ ID NO: 66604 - DNA, 2606 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcgtcggtacacccctgccgccatgctgcccgcctcggtcctaggagcttgggggaggccgggcaggggtcctgaggggcagacagcaagcaagtccacaggcaaagctgggatcgttcactcgcccctggggtcacaagctcagacctggggcctgtgggatgagcagtgaaaacaaacgcaggcagggccgctggccagcaagcaaccgacgggcctgattcaggtctggggcccccggagcaggcagtgcccacggacctctgtggtgctcacagccccagagacaccactgaggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66605 - DNA, 2265 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtagcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66606 - DNA, 2676 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcgtcggtacacccctgccgccatgctgcccgcctcggtcctaggagcttgggggaggccgggcaggggtcctgaggggcagacagcaagcaagtccacaggcaaagctgggatcgttcactcgcccctggggtcacaagctcagacctggggcctgtgggatgagcagtgaaaacaaacgcaggcagggccgctggccagcaagcaaccgacgggcctgattcaggtctggggcccccggagcaggcagtgcccacggacctctgtggtgctcacagccccagagacaccactgaggtaggaagctgccctggagtgatgtccttggggcattggacagggaccctcaccgtagccctccctgcaggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66607 - DNA, 2179 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgaataaacagttggcaacagcaaaaaaa

SEQ ID NO: 66608 - DNA, 2232 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66609 - DNA, 1445 bp, Homo sapiens
aagcagtggtatcaacgcagagtgcccattacggccgggtcaccggcttccagcagcaggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66610 - DNA, 2756 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggtgcgtgcggggctaggggcggggctgccctcctggggcctggcgcccggcgcccacctggcacgtgcccccgcccccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcgtcggtacacccctgccgccatgctgcccgcctcggtcctaggagcttgggggaggccgggcaggggtcctgaggggcagacagcaagcaagtccacaggcaaagctgggatcgttcactcgcccctggggtcacaagctcagacctggggcctgtgggatgagcagtgaaaacaaacgcaggcagggccgctggccagcaagcaaccgacgggcctgattcaggtctggggcccccggagcaggcagtgcccacggacctctgtggtgctcacagccccagagacaccactgaggtaggaagctgccctggagtgatgtccttggggcattggacagggaccctcaccgtagccctccctgcaggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66611 - DNA, 2343 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaaggcgatcactacagccgcccctgccgaacagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatctttcaccaaatggctgcttcacctaaacccaagcaagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66612 - DNA, 2067 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctaggtgagcacgggcggcgggttgaccctgcccccgccccacgccgacagcctgtccagccccggcctccccacactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccagttcaacaaggacgactcgctactgctggcctcgggggtgttcctggggccgcacaactcctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66613 - DNA, 1401 bp, Homo sapiens
  misc_feature (16)..(16): n is a, c, g, or t
  misc_feature (24)..(24): n is a, c, g, or t
  misc_feature (1364)..(1365): n is a, c, g, or t
  misc_feature (1368)..(1369): n is a, c, g, or t
  misc_feature (1376)..(1376): n is a, c, g, or t
  misc_feature (1382)..(1382): n is a, c, g, or t
  misc_feature (1387)..(1387): n is a, c, g, or t
  misc_feature (1390)..(1390): n is a, c, g, or t
  misc_feature (1393)..(1393): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggnnctnncgtgganagcggncggcnaanggngggggggc

SEQ ID NO: 66614 - DNA, 359 bp, Homo sapiens
tggacagggaccctcaccgtagccctccctgcaggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtgggcctcttgccagtgtcccaggcggggtgcccgcaggcggcccacacctagcacagtgcccctcgcccaggtacctgtacgtgaacagccgcgcctggcccaacggtgcggtggtggccgaccccatgcagccgccaccaatcgcggaggagattgacctgctggtgttcgacc

SEQ ID NO: 66615 - DNA, 711 bp, Homo sapiens
  misc_feature (19)..(19): n is a, c, g, or t
  misc_feature (611)..(611): n is a, c, g, or t
  misc_feature (621)..(622): n is a, c, g, or t
cgcagtgctgtgggtgctngctgcagctgggctggagtgcggctgtgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccattcgcgctncagcccgcgnncggacaagcctatgaggtgttggctgtggaacacgggaccgctcatatggggacctgtacgcatctggaaattaacccggccggggctg

SEQ ID NO: 66616 - DNA, 2342 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaaggcgatcactacagccgcccctgccgaacagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66617 - DNA, 2383 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctaggtgagcacgggcggcgggttgaccctgcccccgccccacgccgacagcctgtccagccccggcctccccacactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66618 - DNA, 2606 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaaggtggccgagctgctggcccagggccacaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagcaaaaaaaaaaaacacacaaacacaacaacaaaacggacagaccgcccaagaatataccaaagagggcaccacaaaaagggaacccagctacaggacacaaggtgccccaacagaaacacaaaaaaacaaggcccgaccaccgcatacaacacacccacacgggcaacatgcgcacacgggaacaccacggcgaaggaaaccccacatcagcaggacggcacacacagtgcgaacacaacacaaggcacacaaccgccccaggaaacacaaacccacaggcgcaaacaggcacaaggcgcaaacactgacagcaacaaacgcccacgcaacaaccaccaacactacgaaccaaaag

SEQ ID NO: 66619 - DNA, 2279 bp, Homo sapiens
  misc_feature (16)..(16): n is a, c, g, or t
  misc_feature (24)..(24): n is a, c, g, or t
ttcagtctgtaccccngggcgtantttatatcgtcgatccacgcctcggtagtgacgggggctggcgcatacgttactgagattgcgtgccgatgggccgcctgggcagaatgtcacgatggacgagggcggcacgcccctgctccccgacagcctggtctaccagatcttcctgagcctgggcccggccgacgtgctggccgccgggctggtgtgccgccaatggcaggccgtgtcgcgggacgagttcctgtggagggagcagttctaccgctactaccaggtggcccgcgacgtgccccgacacccagcggccatgtcctggtacgaggagttccagcggctgtatgacacggtgccctgcgtggaggtgcagacgctgcgggaacacacagaccaggtcctgcacctcagcttctcccattccgggtaccagttcgcgtcctgctccaaggactgcactgtgaagatctggagcaacgacctgaccatctcgctgctgcacagcgcggacatgcggccctacaactggagctacacccagttctcccagttcaacaaggacgactcgctactgctggcctcgggggtgttcctggggccgcacaactcctcatccggcgagattgctgtcatcagcctagactccttcgcgctgctgtcccgcgtgcggaacaagccctatgacgtgtttggctgttggctcaccgagaccagcctcatctcggggaacctgcaccgcatcggagatatcacctcctgctcggtgctgtggctcaacaatgccttccaggatgtggagtcagagaacgtcaacgtggtgaagcggctgttcaagatccagaacctcaatgccagcaccgtccgcacggtgatggtggccgactgcagccgcttcgacagccctgacctgctgctggaagccggtgacccggccacgtccccctgccgcatctttgacctgggcagcgacaacgaggaggtggtggctggcccggcccccgcccacgccaaggagggcttgcggcactttctggaccgcgtgctggaggggcgggcgcagccacagctgtcggagcgcatgctagagaccaagccacccgagcgcagtgccacaggcgccaagagcaagtacctcatcttcaccactggctgcctcacctactccccacaccagatcggcatcaagcagatcctgccacaccagatgaccacggcagggcccgtgctgggtgagggccggggctccgatgccttcttcgacgcgctggaccacgtcatagacatacacggacacatcatcggcatgggcctgtcgcccgacaacaggtacctgtacgtgaacagccgcgcctggcccaacggtgcggtggtggccgaccccatgcagccgccaccaatcgcggaggagattgacctgctggtgttcgacctcaagaccatgcgggaggtgaggcgggctctgcgtgcgcaccgcgcctacacgcccaacgacgagtgcttcttcatcttcctggacgtcagcagggacttcgtggccagcggggcggaggaccggcacggctacatctgggaccgccactacaacatctgtctggccaggctgcggcacgaggatgtggtcaactcagtggtcttcagtccccaggagcaggagctgctgctcacggccagcgacgacgccaccatcaaagcctggcgctccccacgcaccatgcgcgtcctccaggcacctcgcccacggcctcgcaccttcttctcctggcttgccagccagaggcgctgaggtgtgctgggtgcactggagccaccgggaccccttgaggacatcgccaggctctgtggctttttcccgagcgggagaggtggagatgcttatagcagttacgccttaggaaggggacaaccaggccccgccacacgctcacacacaaacctgctcacgcagctgtgatgcttggcacggggtggccagtgcagatggagcccaaggccccctcggcctcctgggcaacttggggtacacaggatactgggggtgccgctcctcactcaaccccaggctaggggtacacctgacccagctggcctcggcccggggcaccttcggctggtcctgtggggccctggacggtggcccagtggtggcaggggctgctcctggctgtggttgtgcgcccggggcttgggagcggccggtcacgctgctgtgggcccgagtgtgttgcatgtccacgcaccacccgttcagggccctgaataaacagttggcaacagca

SEQ ID NO: 66620 - DNA, 537 bp, Homo sapiens
tggcctcaggtgatcctcctgcctcagcttcccaaggtgctgggattatatgcatgagccactgcacccagcttgagcagtaattcttaataaaaatgcatcattctttacaatcttcactgaaataaaccaataaaaagcagcttagattttttaaaaattagaaataagtctcaatacttgaccacatgaggattctcatgcaagtagggtacactgtcgcttctgtagggctggagaatggttttccaggggaggtccctgagctggagaaatgtgatttatttttacttacatgtgatatgagagggagaaaacgtaatactcattctgtaccatggagctgaagtgcctattatgtccctttcattaactggggcaatgttactgcatatatattactaattggagactatacctcaatgtcaacaactttagaaaagtggttttatattcaaaccctattcactatccttataatctatgctgtatctctaatgtatcttgcaaataagattatcttaaaattaagtccct

SEQ ID NO: 66621 - DNA, 1270 bp, Homo sapiens
caagattaaagacagagcgcatgagcagagtactgatggtgtgcgtgtttgtgtgtgtgtatatgtgtgtgtataagagagaaagagaaatcgaaaagagagagaaatttcaacttgttttcttttaccagagaatccaagaagcagtttaaggaacctgatattggagtttaatctagaaactggatgatctcatattgattcatgatgcttaatctttcattgaaactccacaattaaaataacaaatagagaaagaaaactaactttcctaaatatggcaaagaaactaacacctcatttatttttatttctttgtaaaaatataaatatctcaatcaaaagtacaggctcatttgtaattatgtactcatgattgtaacagcattgagatttcatataggcacatgtatagcagctgtttgacagtgatggctcttccatgtaacatagcagttatcgtgtaatttagtgccacttattgcaaagtgttaccaaggggaacatttcaaatgccttttgtttttctttggacatcaaggtaatttagtggacaacaaatattaaattttacattatgctttttaattgtggagaaaatgcaaaacctcatgtcttaccacaactttcccatggtattgctaattacttagagtctctaaaattgcccaatattatttccctttgcaaatggtaatttctgataaaacaatacaaaacaaaaaaaaagcagtaatcacagccaaataaatgaaacacctaatgagaattactgttgagtaatgctttttattaagtggcacaaagtacacactaaaaactatgcaaaatataggtaactacagtgtacgtacatgtaagtatcttgtacttgctgtgtatggatgttggaaacccatgtaattataatatgcattttgaatattgggaaagaggaaatcttagtgtagataatagaatttgttttgaaatatacactggcaatattgaaatatactcagtgcaatatctgcagttctattgctggatacttaatgcaaagggattttaaagaattcttcagcaagatccaagaggttgctaatcttcacctctcacatactaaagcattcattaaaaatacaactaattcaaggacaagttaagtttttcttattaatgtgacacagtaacatttttatttggattagtttttggtgttattgcagagaaagaaataacctgagttttaaatttcgattcatatctcattgaattgggaattcttcaa

SEQ ID NO: 66622 - DNA, 469 bp, Homo sapiens
gcaagctgactcctagcacatccaagaatgcaattaactgataagatactgtggcaagctatatccgcagttcccaggaattcgtccgattgataaacgcccaaagccccggatctatcaccttgtaatagtcttaaagcccctgcacctggaactgtttactttcctgtaaccatttgtccttttaactttttgactactttacttccgtaaaattgttttaactagaccccccctccccttcctaaaccaaggtataaaagttaatcaagccccttccttggggccgagagaattttgagcattagccgtctctaggtcgccggctaataaaagactcttaatttgtctcaaagtgtggcgtttttctaactcgcttgggtacaacaaggccaaggtggaaggatcacttgaagctaggagtttgagcaacctgtgcaacctagtgagacccccatctttttaatag

SEQ ID NO: 66623 - DNA, 317 bp, Homo sapiens
atagctgcaaaataataataataataataaaatacttaggaatatacctaaccaagtaggcgaaagacctctacaaggaaaacaacaaaacactgctgaaagaaatcatagatgactcaaacaaatggaaacacatcccatgctcatgaatgggtagaatcagcatcgtgaaaaaattgtagactgcaaaaagcgatctacaaattaaatgcaattctcatcaaaataccaccattattgttcacagaactagagaaaacaatcctaaaattcatatgaaatcaaacaagagcctgcatagccaaagtaatactaag

SEQ ID NO: 66624 - DNA, 444 bp, Homo sapiens
cttttttcagtgtacttctgtcaccttctggtccccagagacaaagtagaagccatcaaagcctccactaatacaggcaggaggacagaggttgatgctaacaccgtgtgaatgtatggataactttatcatatttacatgtgagtgattatgtatcccttttgcttttcagtgtcttctcggaaaaaagcagccttgaaggctacaagtgatgagaaagattctttttcaaatataaccagagaaagaaaggatggagaaacatctaggacaggtaactttgcaaaacacatttaatgtcatgttcagtccagataagaagttctcttccccgaataaatcagtggggggctggtcgaaactgcacattctgattcagtaggcctgagattcttcatttctaataagttcttgggttatgctgatgctgctggtctggaacat

SEQ ID NO: 66625 - DNA, 534 bp, Homo sapiens
cttttttcagtgtacttctgtcaccttctggtccccagagacaaagtagaagccatcaaagcctccactaatacaggcaggaggacagaggttgatgctaacaccgtgtgaatgtatggataactttatcatatttacatgtgagtgattatgtatcccttttgcttttcagtgtcttctcggaaaaaagcagccttgaaggtaataaaactctcatttatattgtgagctagtaaatgtaaagcctatgaaacataccttatttattattttgtttcaaattccattcaggctacaagtgatgagaaagattctttttcaaatataaccagagaaagaaaggatggagaaacatctaggacaggtaactttgcaaaacacatttaatgtcatgttcagtccagataagaagttctcttccccgaataaatcagtggggggctggtcgaaactgcacattctgattcagtaggcctgagattcttcatttctaataagttcttgggttatgctgatgctgctggtctggaacat

SEQ ID NO: 66626 - DNA, 251 bp, Homo sapiens
gttccagtcacagatgtttcattatcactattcaatattattaagcatctaataagtataaggatgcatgagtcaagggtccctaccttcaggtcggaagcaggaaagagaccagatcctagaacaataggacatggtacccgctgcctagacggaatttagaatccggctggggtgaagagattaatgagcgagtcatgccatcaatgtgctgtaactgagtcctaaaaccaccagccgcgacacaaact

SEQ ID NO: 66627 - DNA, 560 bp, Homo sapiens
ataaatagaaaataagttataaatagaaaataataactgccaaattgacatataagacatccggtggtactaagtgataaaaaatgaagaaaggagagtgggggtagggaattgggggtagggactacagagttgtagtcagatgtgctatttggtatagggtggtcaggctaacctcactgaagaggtgacctgcatgcagaggggagaaaatgaggctgatattcagtgaaggaacacaaaatgcagagtggaacacccagtaacacacctatagctgatttctttgccttctctatcctgggtttcttattttgtgtattacaccttgtaagaccctcccacttcaaatgcaggggcaactgatgacttcacaaagatagtggtggttactgtggacatttggtggataatctgtttcttatatgggatacgttcccaacataatcccctaggccactcttgttacaaaatttaaaaaaaaaaacaattttttaaagtcctttgagtttctaatatgccatggatagatatgttttcaattattgcatttggagttc

SEQ ID NO: 66628 - DNA, 511 bp, Homo sapiens
atgatgtgttgtaaaacaccaaatagacccgggctcataataggagttcagacagtgcgattttcctccctcctcctttcatggtggtctttaacttgtatttattctgaagtttgttaaggctgttgggaactcagaacacatttactcataaaaaccagtagccctgggctttgtgaggtctgacccccaacccctgcctaactcaccatccccattctcttcccatcaccctcattcagggacttgactttcaagacatggtgggttcttctgctgtcttccaaatacccccttgggttccccacccataagcttttgctccttcaccccagaatctcagacctttgcttagaactgtccatcaaatcaatatccaggtgaaatccaaattctagctcctccatctcccagtgttatgcagaactgctttctttctcgtctgaattcttattctactttatctgaccgagtagtaatatgagctttataataaaaatcacaacatatt

SEQ ID NO: 66629 - DNA, 340 bp, Homo sapiens
gaactccatttttctcagattgaaacatacatgcttatgtacaaacttcatagatgtagctttaaggtattgatggattttaaacagccttccaataaagcaacagtacccagacttgtatagcaacccaatatgtataattttaaatatgatagcactttcatgtcagagtaagttccatttagaatgtcagtcttattatatgtaattgatcttatgtttgtttatttcctcaactgtctgtatcttacctccttgtaattgcttacatagccaagaagccgatcattcagtttataagtgttaagaattaataaaaggatacttgtttccaaggact

SEQ ID NO: 66630 - DNA, 744 bp, Homo sapiens
acattgagtcagtcatgccagtgttagcttttgaaacatgaacactgcccgcacctgactggcatgcaactgacattttctttcacaattttctgctacttttgctaaaaataataatatccatgtcttgcttttaggcctaagatttttatagcatatgtgggaatatatgattgtttttctagatgtgtagaggaagatagtcttgaatgcagtgtgatattaaaggatcccatttaagatttttgtaatatgcttcaaagacctgtgggttgcaaagttaccacttttgagggcacatgctccatgaagcaccttatgtgacaatttacaattattgttttgttttgtcactctgtagaaacctcaaatgaaggtgtagttgggctcaagcatccagattatcttttctcttcttattttttcttcttttcccaagatggagtcttgctctgtcacccaggttggagtgcagtggcatgaccttggctcactgcaacctccgcctcctgggttcaagcaattctcttgtttcagcctcccgagtagttgggattacaggcacctgccaccacacacggctaatttttgtatttttagtagagagagtgtttcatcatgtcggccaggctggtctagaactcctgattttgtgatctgccagtctcggcctcccaaagtgctgggattacaggtgtgagcgatcgtgcccagcctgtcttgtcttttcaaaaccatccttgg

SEQ ID NO: 66631 - DNA, 294 bp, Homo sapiens
cggaggtgcgtttcctgcgtcctcccgagtggggttccctgaggtcacctgtcctgagggtggtgctcatgtggcctgggccacgcccccgttgggctggctttgtcacaggaggctggtctctggggtcaggaacagctgttttgggatcagattgcgctgagtcaccaggcggccaggctcaccagacctgtgggcctcaggccttgcaccttaagtgtgagcttattccgtgagagggttgcgcagaaagcacgctgtacaatccgaggcctcttgataccaggtttcgcc

SEQ ID NO: 66632 - DNA, 2477 bp, Homo sapiens
gctgaagtaccggtcagccagcctcctgctgcagagccagtgaactcaggtcgggcttctcagctgcgcacataggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaaggtgctgaaaccaagaacctacagttactggttccaaaaactgagatatgtgaggaagctgaaaaacccctcatcatatcagaaagaatccagaaagctgatcctcaaggacctgagttaggagaagcttgtgaaaagggaaacatgttaaagaggcagagaataaagagagaaaagaaagatttcagacaagtgatagtgaatgactgtcacttacctgaaagcttcaaagaagaggaaaaccagaaatgtaagaaatctggaggaaaatatagccttaattctggcgctgttaaaaatccaaaaacccagcttggacaaaagccttttacgtgtagcgtgtgtgggaaaggatttagtcagagtgcaaacctcgttgtgcatcagcgaatccacactggagagaaaccctttgaatgtcatgagtgtgggaaggccttcattcagagtgcaaacctcgttgtgcatcagagaatccacactggacagaaaccttatgtttgctcaaaatgtgggaaagccttcactcagagttcaaatctgactgtacatcaaaaaatccactccttagaaaaaacttttaagtgcaatgaatgtgagaaagcctttagttacagctcacaacttgctcggcaccagaaagtccacattacggaaaaatgctatgaatgtaatgaatgtgggaaaacatttactaggagctcaaacctcattgtccaccagaggatccacactggggagaagccctttgcctgtaacgactgtggcaaagcctttacccagagtgcaaatcttattgtacatcagcgaagccatactggtgagaagccatatgagtgtaaagagtgtgggaaagcctttagttgtttttcacaccttattgtgcaccagagaattcacactgcagagaaaccttacgactgcagcgaatgtgggaaagccttcagtcagctctcttgccttattgtccaccagagaattcacagtggagatcttccttacgtgtgtaatgaatgtgggaaggccttcacatgtagctcatacctacttattcatcagagaattcataatggagaaaaaccttacacatgtaatgagtgtgggaaggccttcagacagaggtcgagcctcaccgtgcaccagagaacccacactggggagaagccctatgaatgtgagaagtgtggtgcagctttcatttccaactcacacctcatgcgacaccatagaacccatcttgttgaataacaagtaaggaagaggaagacctccagcattggtcataaccttctgcctccctaatgagacacctctttgctgttttcttcctcctctataaaagtgagggctgtgtccttaaaagttatagttttcaggaatgcagcagaagacacaagaaaagcatttcagaggctaatttaaaacaaaaagtaagcacctaaaggcaaggactttgttttaactgtaccttaagcggtcatgttctctgaagtggaatgtggctttcctaggaatgggtcgtacaaagctaagtggtaatgatgctatttggggaaaggtcttttttgcttaattttgttttttaaaactctgatgattgcttgagcaacaggcaggttatctgcctggttgaattctggttgaaccgtgtattctaatatttctggttaagtggtgactgggtaaggaaaccacttggggtagcagttcaacaattcacttacgaatgtttataagctttccatttcctaggtaattttttaaaagccagtcaaaacaaaaactttactgaaaatggacagaaataggaaatggactttttccttactgtctatacctcctgaaccttggtattgtaaagatctggggacctctgggtctgttctgaccattccctagtctccatggccaagcactcaaggattgatggacaccacacaccagctatattcatttgccaagatcaacagctccttctccaaacaactcaagcccccaattcccatcgcattccatttgggtgagatgcaactaacagccccttcctggatgaaggagtcaaagaataaagcttgcctagaggcatg

SEQ ID NO: 66633 - DNA, 2622 bp, Homo sapiens
gctgaagtaccggtcagccagcctcctgctgcagagccagtgaactcaggtcgggcttctcagctgcgcacataggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaagggtcagaacatatcctgggatatggcggtagtcctgaaagcaactcaggaggcacctgctgcttcaacccttggcagctactcattaccagggactctggccaagagtgagatactggagactcatgggaccatgaactttctaggtgctgaaaccaagaacctacagttactggttccaaaaactgagatatgtgaggaagctgaaaaacccctcatcatatcagaaagaatccagaaagctgatcctcaaggacctgagttaggagaagcttgtgaaaagggaaacatgttaaagaggcagagaataaagagagaaaagaaagatttcagacaagtgatagtgaatgactgtcacttacctgaaagcttcaaagaagaggaaaaccagaaatgtaagaaatctggaggaaaatatagccttaattctggcgctgttaaaaatccaaaaacccagcttggacaaaagccttttacgtgtagcgtgtgtgggaaaggatttagtcagagtgcaaacctcgttgtgcatcagcgaatccacactggagagaaaccctttgaatgtcatgagtgtgggaaggccttcattcagagtgcaaacctcgttgtgcatcagagaatccacactggacagaaaccttatgtttgctcaaaatgtgggaaagccttcactcagagttcaaatctgactgtacatcaaaaaatccactccttagaaaaaacttttaagtgcaatgaatgtgagaaagcctttagttacagctcacaacttgctcggcaccagaaagtccacattacggaaaaatgctatgaatgtaatgaatgtgggaaaacatttactaggagctcaaacctcattgtccaccagaggatccacactggggagaagccctttgcctgtaacgactgtggcaaagcctttacccagagtgcaaatcttattgtacatcagcgaagccatactggtgagaagccatatgagtgtaaagagtgtgggaaagcctttagttgtttttcacaccttattgtgcaccagagaattcacactgcagagaaaccttacgactgcagcgaatgtgggaaagccttcagtcagctctcttgccttattgtccaccagagaattcacagtggagatcttccttacgtgtgtaatgaatgtgggaaggccttcacatgtagctcatacctacttattcatcagagaattcataatggagaaaaaccttacacatgtaatgagtgtgggaaggccttcagacagaggtcgagcctcaccgtgcaccagagaacccacactggggagaagccctatgaatgtgagaagtgtggtgcagctttcatttccaactcacacctcatgcgacaccatagaacccatcttgttgaataacaagtaaggaagaggaagacctccagcattggtcataaccttctgcctccctaatgagacacctctttgctgttttcttcctcctctataaaagtgagggctgtgtccttaaaagttatagttttcaggaatgcagcagaagacacaagaaaagcatttcagaggctaatttaaaacaaaaagtaagcacctaaaggcaaggactttgttttaactgtaccttaagcggtcatgttctctgaagtggaatgtggctttcctaggaatgggtcgtacaaagctaagtggtaatgatgctatttggggaaaggtcttttttgcttaattttgttttttaaaactctgatgattgcttgagcaacaggcaggttatctgcctggttgaattctggttgaaccgtgtattctaatatttctggttaagtggtgactgggtaaggaaaccacttggggtagcagttcaacaattcacttacgaatgtttataagctttccatttcctaggtaattttttaaaagccagtcaaaacaaaaactttactgaaaatggacagaaataggaaatggactttttccttactgtctatacctcctgaaccttggtattgtaaagatctggggacctctgggtctgttctgaccattccctagtctccatggccaagcactcaaggattgatggacaccacacaccagctatattcatttgccaagatcaacagctccttctccaaacaactcaagcccccaattcccatcgcattccatttgggtgagatgcaactaacagccccttcctggatgaaggagtcaaagaataaagcttgcctagaggcatg

SEQ ID NO: 66634 - DNA, 2539 bp, Homo sapiens
gctgaagtaccggtcagccagcctcctgctgcagagccagtgaactcaggtcgggcttctcagctgcgcacataggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaagggtcagaacatatcctgggatatggcggtagtcctgaaagcaactcaggaggcacctgctgcttcaacccttggcagctactcattaccagggactctggccaagagtgagatactggagactcatgggaccatgaactttctaggtgctgaaaccaagaacctacagttactggttccaaaaactgagatatgtgaggaagctgaaaaacccctcatcatatcagaaagaatccagaaagctgatcctcaaggacctgagttaggagaagcttgtgaaaagggaaacatgttaaagaggcagagaataaagagagaaaagaaagatttcagacaagtgatagtgaatgactgtcacttacctgaaagcttcaaagaagaggaaaaccagaaatgtaagaaatctggaggaaaatatagccttaattctggcgctgttaaaaatccaaaaacccagcttggacaaaagccttttacgtgtagcgtgtgtgggaaaggatttagtcagagtgcaaacctcgttgtgcatcagcgaatccacactggagagaaaccctttgaatgtcatgagtgtgggaaggccttcattcagagtgcaaacctcgttgtgcatcagagaatccacactggacagaaaccttatgtttgctcaaaatgtgggaaagccttcactcagagttcaaatctgactgtacatcaaaaaatccactccttagaaaaaacttttaagtgcaatgaatgtgagaaagcctttagttacagctcacaacttgctcggcaccagaaagtccacattacggaaaaatgctatgaatgtaatgaatgtgggaaaacatttactaggagctcaaacctcattgtccaccagaggatccacactggggagaagccctttgcctgtaacgactgtggcaaagcctttacccagagtgcaaatcttattgtacatcagcgaagccatactggtgagaagccatatgagtgtaaagagtgtgggaaagcctttagttgtttttcacaccttattgtgcaccagagaattcacaagtggagatcttccttacgtgtgtaatgaatgtgggaaggccttcacatgtagctcatacctacttattcatcagagaattcataatggagaaaaaccttacacatgtaatgagtgtgggaaggccttcagacagaggtcgagcctcaccgtgcaccagagaacccacactggggagaagccctatgaatgtgagaagtgtggtgcagctttcatttccaactcacacctcatgcgacaccatagaacccatcttgttgaataacaagtaaggaagaggaagacctccagcattggtcataaccttctgcctccctaatgagacacctctttgctgttttcttcctcctctataaaagtgagggctgtgtccttaaaagttatagttttcaggaatgcagcagaagacacaagaaaagcatttcagaggctaatttaaaacaaaaagtaagcacctaaaggcaaggactttgttttaactgtaccttaagcggtcatgttctctgaagtggaatgtggctttcctaggaatgggtcgtacaaagctaagtggtaatgatgctatttggggaaaggtcttttttgcttaattttgttttttaaaactctgatgattgcttgagcaacaggcaggttatctgcctggttgaattctggttgaaccgtgtattctaatatttctggttaagtggtgactgggtaaggaaaccacttggggtagcagttcaacaattcacttacgaatgtttataagctttccatttcctaggtaattttttaaaagccagtcaaaacaaaaactttactgaaaatggacagaaataggaaatggactttttccttactgtctatacctcctgaaccttggtattgtaaagatctggggacctctgggtctgttctgaccattccctagtctccatggccaagcactcaaggattgatggacaccacacaccagctatattcatttgccaagatcaacagctccttctccaaacaactcaagcccccaattcccatcgcattccatttgggtgagatgcaactaacagccccttcctggatgaaggagtcaaagaataaagcttgcctagaggcatg

SEQ ID NO: 66635 - DNA, 3171 bp, Homo sapiens
  misc_feature (314)..(314): n is a, c, g, or t
  misc_feature (2402)..(2402): n is a, c, g, or t
ccttgggcagtatggccattttcacgatattgattattcctatccatgagcatggaatgttcttccatttgtgtcctcttttatttcgttgagcagtggtttgtacttctccttgaagagttccttcacatcccttgtaaggtggattcctaggtattttattctctttgaagcaattgtgaatgggagttcactcatgatttggctctctgtttgtctgttattggtgtataagaatgcttgtgatttttgcacattgattttgtatcctgagattttgctgaagttgcttatcagcttaaggagattttggnctgagaagatggggtttcctagatatacaatcatgtcatctgcaaacagggacaatttgacttcctctttttctagttgaatacactttattcttatagctgtgtagtggtatctcattctgcttttaatttgcatttcctggtgattaatgatgttgaataacatgcttacttgttattatatctttggtgaagaagtttggtgaacttggtgaagtttctgtttgtatcttttgcccatatcattcatatatatatatatacacacacacacacacatacacatatatatatacatatatatatgacaaaagtcagatatttaatttgcgaataatttctcccagtatgtgacacatctttcctttttaaaacattttgttactgaaatgccaggggtttgatctagatctcattgtttacagcacagaaagccaatcactggaacaaagagtactgccagggaagaaggctttatttgggtgctgcagctgtggagatgggagatagtctcaaattgtctcactaactgactaaaattggagatttaaataccagggaaagaatgtagaaaacaggaattagggaggagtaaggaagaggaatctggtctctcactgtctggatgcggtgatctggtgagtttcagttcctttatactctctgggaggcccgagcgtcagttttctaagaaaggaactcagataagataaatataagtttcaggcttaagaccaagagggccaatttctgtttatttaaaaagaccataaacatcagttctgtgaggaaattgggctggtttcaattttcttcataatgtctttgaagtcaaaagttttgatgaagtctaatcttactaattttttcttttatgttttgtgtgatatctaaaaacctttggcctaacacaaggtaacaagattttcctcaatgtttctttctcagactttcatagctttgggtttcacatgtaggtctttgatgagttttgagttaatttttatgtatgacgtcaggcaagagttgaggtgtttttttttcataaggctgaatgttccaaccccatttgttaaagagactctcctccctccacttaccttggcacctttgtcaaaaatcagttgaccatgtatgtgtgaatacatgtttctgatttatcaatgtaacagaatattccagaaaaatatgaataatttttgtttctcaaatgaactaccagtcattttaacagcataaaatcgatttcttgataactttacagtgaattttgaaatctggtagtttgagtccttctactttgttcttatttttcaaaattgaattggcaacattggttcctttacctttccatacaaactttagaattaaaggttaacatctccaaaaatatctgctggcattttgattagatttcattggagtatagattaatttggggagaattggcatcttagcaatactgaatcttccaatttatgaacatggtatacctcctttgatttagtcctctttaatttctctcaatgatgttttataatttttaacatgcaacttttgcacatgttttgttagctctgtttttattttctgttttttgatgctattgtatatgatactgttttaaaattttcagtttccagttgttcattccttgtttcatacccaatcaaatgttaaacctcattcaaatgtcttggtggggagaactgtgttgtgtttgttgcaagcccctcctccttctttctgaacctcaagttctaagcaccaagagactttagcagatttcactctgtgtttcatcccacaatacctatggccagaatcacccccaaaatgatggcaggagattccccacaagggagtgccccaaactgtccagagatagggccggttgggattccaaaaaaagaaggaaagactaaatgccagagtggtcaatccaaagcatttattggggaaacttacagagtgctgcagcagtcctcaaaatgaacagtaagagaaaacaggtgttctacctaggtatgactgcagtgagggggtcagggtatgagagtttaaggaatttggctcagggccagggcnagtttctttttcagtgttgtgggcagcaacctagatacctttatcagtgcctaggaatgttccaggcccaggtttgggttcaagtctgctacgaaaaacctgcaactggatagatcacagagcagtcaggacacagaaagaaagtagtggggaacggagaaccctacactctttctcattcaacttcagagctctcatgctgttccacttctcagaaaatcacccataggggaatctggccctcgctttttaggttcctgttcgtcttgccagattttacaaccatcacctattctgttggtgcctcctcttaccttaagaatcctctgcctgagccaagctggattgtctccctgtgcctagaattagcaaatgtccccagagaaaaacatgaccagtaacttcaactcattgatgagaggccatttcccttctgaaattttagttcttctagtccattgttaaaagaaaaaccttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaa

SEQ ID NO: 66636 - DNA, 2855 bp, Homo sapiens
  misc_feature (1)..(1): n is a, c, g, or t
  misc_feature (820)..(820): n is a, c, g, or t
ncattttccatgtcgtctttcctggtgcagatgaagggtgctcagcagagcgtgagccaccagggaagccactcgcctactccagttcgaatattggggacttgaggccatcttgtcttttttgtgtgtgtgtggcgtctgatttacaacttcttggtcgggcagctctgtgggttgctgatggtccatgctgtcattcacatcgtccgtggtgtgcactggaagatctccatgctgtgaagcgtgcaggatgtgcttcacatcagtcacttggggaagttcaggaggctgctttttcatgcttttttcagaagctcgcctaggttaggtcctgatcggaagacctgctcatttccattagaaccttcaagcagagtgtttggagcaatcaaggactggccccagcatggataacaggtagctaccactggtgtgggctgctggctgcatcttggcgcaggcctttctgtgggcctcaccttagactgaagccctttgggccagcccttccctccttctcactgcgtgtcgtctcctgaccagagaggccatcacagcggtgcacgcccagctcacccatagtatccctagggtcactggcactggtcccaggattctgtacatcactacttactgctgcccacaggtgggccagcagcagttgaggaggcatttcgtggtgagcagcaggtccttcatggctcttgagggctccacagctcttcctcttttctctactggtatgtgggtcacaactgaccactcagaaccctgcagagtgttccacctctaacacaaacaagggctcgccaaccagggnaaaccatccattatgctgggggaggaaaggcaccgcaaattctagaaaactgtgtccctgattttgctgtgcaaatataaagtgacattacttaacacagtgccttggaagaggggaaagagttcacggcagcccccagctcaggccactgcaggtcccacctggccttacagcatagctagagggtcaaagccagtcaaagccccgtgtccacgcatgatcctctcagggcagcgtgatggcccgtccctggtggggctcattaccctgatttcaagtttccttctgctgcagggaagcctggtcccgcctacaaagagactgtctaccttgctagattgaactataggactatgttttcttcatctctgtaaccccagaagctctccagagacccttatacactagggacatggtcattgcttgtcttgttttcttgttgactctactctgacttagggcacatcgctttcccctctagatctccatattcagatctgtgaatgacagtaagtgggtgaaggcccctctagctttaaaacccctccaatacagagagtacactgaaaccggaagcagaagctgagtgtggtgagtggagcattttccctggcatgatggaggggacctatggatctggctatgagggtggcatctggccacttgaatggctctgcagagctggaccctagttttcaaatcagactcaagaatgatctttagtgtgggtggttttgtggggcatatattttttgagaccttgttattgacacaacagcttctgggaagtctttttgacagagagtatgcacaggtgcgggctccatctgctcggcagccgctgtctggtgacggtgagcgctgagagctggatggtcctgttagaaaggcagcatgccagcctccggtgatgagcagagtgacccgaccttgtctctccttccccatggagcactgcaggctctttccccagacctgcttctaggcttcccttcacccgctcccaccaggcagctgaggccactttaggattccatttttagttgtactttttttttaattgatcattttgtgagcatttttctctctaatgcaacagaactagcacaagtccttaaagatgtaggatctctcagctcccacaaaaacaaagataatggcctatgtaattctctacatatttaaattgttagctctaaaaatagattcagagaaagggtggacacatgttccaattttctcataacagtcctgggttgtgcctgttatcctggcatagttattaatcctgtcccctttcactctcagactctcctggtttggaggataatttcattctattcaaagaggaaatctacaaaaaggtgtcatcatctaacctgtattcatataaacattttccagtctcacggttctgtgtacctctccaaacccctcaatcttctaatcattttgtgtattatttataggaaaagagcaccagctaaaatatcttgcccttggatttcttcagccagctgctgaagtaatttgtcttagtctttactgaagactgaattgtatcattaagactttcttctaagtcctgttattttgactttttgactcactctgtgccctctgatacataaagtagcaataatttgtacaatgagccattgtatttgttcacgagaaattcttcctgttcctcacatttctattcattttcctaaaggtatgtatttgaaaacttgaaaaattgcctggcccggttatagtttaatgggagcatttaaacatacttttcctacaaagcttatcagttagttacttaacctttatgaataggttaaatattttccacagtatttatataaatatgatacttggtttcaagttaaatctaataaaaaggaagttattcttgacttaaattactcccatttcttttcatttgtttttatcttcctcttttttatgaccacttgactaagaaagaaattcacaaggcagatgtggaaatgtcgctttataaatacaagattcagccagt

SEQ ID NO: 66637 - DNA, 334 bp, Homo sapiens
cagctcttaaggggacagcctgggaaaacagacttagggacaatgatcttgagccatgaaatgatgtccaatgccccttgtgccacctgacatcagcctgattaatgaacaaacagaagaggaagcaggggacctgtgtgtccctctctctgcttttctgtctttctccgtgccccctctcttatgtctctcacgctgtctcttgtccttgtttttaactctgacacgccgtgggaactcggctcacttcctagggggaagctgtctggactggcccagagatgggcaccaccatttcccaataaacacaagataaaatcagaaactggcgtca

SEQ ID NO: 66638 - DNA, 358 bp, Homo sapiens
  misc_feature (349)..(349): n is a, c, g, or t
ccccaacacttctgttctcctttgcatcatgtttatggtgtcttatatttatggataatgctacttattaaaactgtctaagttttgtccgtttacacatttcacaattaaaggactactacaacaattttcctaagtcctcctgctttagtttctccttattccagtccattctgcagttaagacttaaaaagttttaaatactgctttcaaataatacttgcaacataattccctcaactccattagctcctcagagtaccatttctttatcttctttccttttactgccaaaaagacgtgaaaaccactagctcagctgctatttttctatctactgaaattttcntgtaaagtt

SEQ ID NO: 66639 - DNA, 399 bp, Homo sapiens
ggaaccacaaagactgctaatagccaaagctagtttgaacaagaagaacaaatctggaggcctcacactttctgatttcaaaatatattacaaagctacagtagtagcataaaaacagatgcataaaccaatgggtagaatagacagcccagaaataagcccacttacatgtggtcagctaagttttaacaagggtgctaagaatacataataggcaaatgatagtctcttcaatcaagtatggagaaaattggatatctacatgcaaaatgatgaaactggaccattttcttgcaccaaaaaatcaactaaaatgggctaaaggcttaattgtaagacctgcaatcataaaactcctagaaaaaagcataagggaaaagcttcttgatattggccttg

SEQ ID NO: 66640 - DNA, 545 bp, Homo sapiens
tacactttctatttaatgcatttgcaaactctatttttaagtattttcacagatattttgcagatatttgcagtgcagtggctctacctgagcttatttttaaatgcacaatttttatcgaccattataaatatatgtaagtatattaatttctaagaatatgcattaacttacaagatttctgtacactccaacattattttctcacagtataagcagactgcaagcaaaatctgaatgggataggttttttttccctctcacatatattaagaagttatccttatcattttcttttaggttagccttgtacaacatcttttaaagtaccatttactatttttagggatacattgaactatgttcctatttttttttctttaaatcaaattacgatccaaatgtacttcattcagaattgtgattggttacttaagcaagcctatgtacttctactatctttttaaaaatcttgatttcctgttgttatactcatatttcccctgtgaactttagacagtgaaataaatgctttgtccttactt

SEQ ID NO: 66641 - DNA, 447 bp, Homo sapiens
cccttgctatcatacccatcactgaatcttaaccaaaaacctaaaggtaataaatctaaggaatatttaaacgtggggtaaaataaatggcaaaaatcgatattgattttaagcctctgaggttaggcactatgcgaggagctgtggacaaatgccatttggttcagcctcatttctcttgagattaccaggtcttcaaagcttgtcaaggcacgtggcatgtcagtgtgtacaaggaacatgaattataaaatcaaggcagaaggttccttccgtcttttataaccttttctgcttttgaattccgaactaactttccatttcatctatagacaggtattttgctagtattaaagcaccacaagacatatcctgtgtagcagtgtggtccaatagaaaatcaagcaagccacatatgtaattttagatgcttttgctttccacatt

SEQ ID NO: 66642 - DNA, 1254 bp, Homo sapiens
atttagcttggaattttcctattggttcctaacaaactgtcccaatgtcatataaggaaacatgatctattacattcctttataacaatgtggagagactataaacctatgtaagtagtaaaactatatcagagactcaggagactgactaaaaggcctggatctgcagtgtattatctgtataaaaattggcagggggaagctaaaaggaaaggagattggagatctcaattctatcatggtgtatttcatacgcaaatcagagcatgcattgttttttgtttttggaaagagaagggaagtgtgttctgccccatgtttccttccgtgtttatagttcaaactctatatatacttcaggtattttttgtttagcccttcattataaatgggcaggaaattgtttatcaacctagccagtttattactagtgaccttgacttcagtatcttgagcattcttttatatttttcttttattatcctgagtctgtaactaaacaattttgtcttcaaatttttatccaatatccattgcaccacaccaaatcaagcttcttgattttcaaaaataaaaagggggaaatacttacaacttgtacatatatattcacagtttttatttataaaaaaaatttacagtacttatggagagccagcagaagacatcagagcactcacttcttcccatctttgttaaggttagcgaattacccatggacactgttaggtgaggctcattcggcagccctgaaaacaaacctggtcacactgtctttaccctctcccttcagataaagcacttcgattatctattgatctgcccagttttcaagtcatgcgaatactaaaaaggttacatcatctggatctgtaccttggctatataagcatgttttccccctattctatgtttctttttttggtgaacattgaaaaacaggaggtgacttattactgttaattaaaactaaatgaaaaatgtcaagtctttaaaacagtgagcttgtaactctttcatgtaattttattctctatgaatttggctatcctactgaatcttaaaataaaggaaataaacacttttttttaaaaaaaaaggaaaaatacaagtctaaaaatctcaatgaaatatttcacaagaaggaaaaatgtaagttagcctttgctttccactttggaataagcaggaggttagggaaggcattgagaagaaaaaagataaaaataatatgtgttgttcagtgcagtgcct

SEQ ID NO: 66643 - DNA, 205 bp, Homo sapiens
ccacagatgttcaagacaatccgttacagtccaaggagaaaatactagaatgtctgtctatatttgcttcctttcaaaatgagaacacaattaggctttcctagtatgtaatgctggattctcatgatgccctccctcagttcagacatgagacagtcagatgtcttatgtgactgcaattgctgtaggtagaccacatctgcaa

SEQ ID NO: 66644 - DNA, 2272 bp, Homo sapiens
  misc_feature (1)..(1): n is a, c, g, or t
  misc_feature (1421)..(1421): n is a, c, g, or t
  misc_feature (1572)..(1572): n is a, c, g, or t
ncttccatgctgtgaaagttttgttcttttgctcttcacaataaaccttgccgctgctcactctttgggtccacactacctttttgagctgtaacactgcgaaggcctgcagcttcactcctgaagtcagcaagaccacgaaaccaccaggaggaacaaacaactctggacgcaccacctttaagagctataacacacactgcaaaggtctgtggcttcactcctgaagttagcaagaccacgaacccaccggaaggaagaaactccagacacatctgaacatctgaaggaacaaactcaggacacaccatctttaagaacggtaacactcaccatgagggtctgtggcttcattcttgaagtcagcaagaccaagaacccactggaaggaaccaattccggacacactagcttaaattaagaaggaatttaaagcctctcaaaaatgaaaagtgtagactggtgacacctacagacatggattgaagcaggagcccatctattcaccgctactttatttttctccatctccagttacaattcccttggttcattcagaagcagattttccttcatggtggcaagatgtctgcaactgctccagaaattgtatttattcttgttgagtccagaaagaaagagagtctagaccagaatttcaagaaaaacttctattgggtctcaaagcatctgatagagccatgcatctacctttaaattaaaaactgaggtcagaggatataaagttccttaactgacttagcctggtaacgtttgtgaaaataagcgattcaaattaaagctgttggaactttcaattattttgagtcttaaagaaaatgtgattgtttctctaattatagattaactttttccttacctactttgttttgtaaaatgttgcaaaagattaaatgacaccagagataagctctcttccctcttacttgttgaccctcattataggttaacttcctccttttttctcttgcacctgacacagatcagatagcacaaagactctatgattatcaagttgctcaagatgaactgttaagtatacctttcccaaaaacgaacaagctgtaactaatcaaattgtaattcataaaccagctttatatgaaaatgttgtaatcctactaaatttctttgtttctacctataaaggtaaaatcctagttctccacttcagaacactgaccccattcatttggagtctgtgtttcctgggcagccatccttaaatttcacacttgagtaaattctttagaactggattctgatcattttgattatttcaggttcacacattcttattgggagtttgaatgagaatggggtggagaagggtacaaaggtccacggactgagaataaggggggaaaaaaagtggttttccagagaggaatcaggaattnttaccaaaaatgagacaatggatgtccagtggtataaaataacatgtccactaaagaggatggcaagtaaataattatcactaatgccatattacataataattttccatatttcactaaatacaatgagtgaggttatcaacatcatgcngtatcatttaatgtccatgtttcaaatgtaaatacaagacatattacataatacgatgtaaaacagtgaagttcacactaaagtcatatataataagatatattttgtgttaaggaaaatcttcattttcctatatcccggatatcattatcaaaaaataatattgatagtggtgttattaaatgtaatatttgggttatctacctattgtagtcccaagctatcaaattttcattttacttctatttctagcaacaaataggaaagtcaatcaatttagatctaatttatgttccataaactgtcttctagcttaaaaaatattaatttaataaatcactaggttttgacttttataaatacaatgagtattatagaatcttcaatttctcatctattttatattgctatggttgaagtagagaaaaggaagaaatctggtgatttgttgtattttggagatctttgcaaagaacaagtcaaatttgactttgagattctagctcaagcatcagattagatgtcaatgtcatttacaaggatagctaatatcacaaaaaaagtagctattcagtggtttttgattgtcgaagaaagtgagggaacaggtagaaaacgaccacaatggtagtattttcacagttatttgtagatttacgtaaagcaaataaaaaaaaaaatcagttgtctaaaaaaaaaa

SEQ ID NO: 66645 - DNA, 117 bp, Homo sapiens
gctctcttccaactacccttgggctaactgtgccttgttccgctggtcgttggcctgctggtgtctgctggtgcttgtcagtgtgttcttccactcctctcgaagtccagctgcgcg

SEQ ID NO: 66646 - DNA, 563 bp, Homo sapiens
gcggccagcctggggactgcgcgggtaaggagcgggagggcggaatgcaccgcgaagttggcgggggacggccacgcacgcctcgcctcggccttcctgcaccgtagggccgccctcccgccacccctgggcacctgtcgaccacgtctgggcgagggcgggtcggctcccgccctcgggccctcaccgcggcggggacgccgggtcagcgaagggttaagggactcgctccctcctctcggctccctcacccttggaaagtccccgaaatgacgtttcaacccgacaatttaaaaaagagtttaattatagagacaggctctgggagctggaacaaaccctcggtcggcggggccggtaaacaactcgggagcgagcgggctaggccagtcgcagccttgcggagcccgcgcccccggggagagggggaggggagggcctccgggattgggtttcacaaagttgaaaaacagccggtttctcaaacaattgtgatttggaaggtttcgctgggtttgcccagatgtttacgaataaataagaaacgcagttttaaaaaaaag

SEQ ID NO: 66647 - DNA, 1329 bp, Homo sapiens
gcggccagcctggggactgcgcgggtaaggagcgggagggcggaatgcaccgcgaagttggcgggggacggccacgcacgcctcgcctcggccttcctgcaccgtagggccgccctcccgccacccctgggcacctgtcgaccacgtctgggcgagggcgggtcggctcccgccctcgggccctcaccgcggcggggacgccgggtcagcgaagggttaagggactcgctccctcctctcggctccctcacccttggaaagtccccgaaatgacgtttcaacccgacaatttaaaaaagagtttaattatagagacaggctctgggagctggaacaaaccctcggtcggcggggccggtaaacaactcgggagcgagcgggctaggccagtcgcagccttgcggagcccgcgcccccggggagagggggaggggagggcctccgggagttggaaaagccgaggaaattcgaggaatcagctttctttggaaaaatccactttgtagccattctggggcgcctgatggtgctcctggccggtcccgcagccttggagggaaagcggcgccgcccgaagcaggggcatagccggtgccccgcggggacaggccctgggccgggaagggggccccgcccgctcccagtccccttcccctttgcttttttccagcccctcctccggtccccccagctgagcttcgcgaaccctcgggagttaaagaccagccggcctcttttttggggggggtggggggtgggggagcgggaatgggtggaggccgggggaataaaaaaccgaaatagcttcacatcagaactcagactaaccttgtggtttcaacgcgcactctgctctgtcctgaaatctggaactcattacctcatcaccaagaaactgcacgaaatctctcccccaccgccccaacacccacttgggaaaggaacgagcaaacatccctctaagaaagaaacctacacttgaatgatttaaattaaggtggatggaagttatttccctttctggcgcttgccagatttcaagaaaagctgaaaaatgggagcgggggagggaagcaacagacggctggagggcagcagcagaacaagcgaggggcagcagccgagttaaagtgggggccatccatttcgggcagaggagacaaatgaaagccgaccccgctgggatcacgtaggttcgtggctgcagcaaaagttgggtttcacaaagttgaaaaacagccggtttctcaaacaattgtgatttggaaggtttcgctgggtttgcccagatgtttacgaataaataagaaacgcagttttaaaaaaaag

SEQ ID NO: 66648 - DNA, 489 bp, Homo sapiens
cttcctgctctgctccccggaatcctcagaaacgggatttgtatttgccgtgactggttggcctgaacacgtagggctccgtgactgggacaggaatgggcaggagaagcaagagtcggagctccaaggggcccaggggtggcctggggaaggaagatggtcagcaggctgggggagaggctctaggtgatgaaatattacattcccgaccccaagagagcacccaccctcagacctgccctccacctggcagctggggagccctggcctgaacccccccctcccagcaggcccaccctctctctgacttccctgctctcacctccccgagaacagctagagccccctcctccgcctggccaggccaccagcttctcttctgcaaacgtttgtgcctctgaaatgctccgttgttattgtttcaagaccctaacttttttttaaaactttcttaataaagggaaaagaaacttgtaaatgcttcttgag

SEQ ID NO: 66649 - DNA, 535 bp, Homo sapiens
gtcacctataagccaaacagcctggcctaactccagggtcattgaccacttgttttccccaactgccaccacagcaaccaactgtatgggccctgcccagagactactgaagcaacagactttacattggcacatcccagtggttcccctccctttccccaagccacacacatctcacctcccaccccaagagggctgagatagtgcctaactgttgggcttctaacaaagtgtagccgtaagtgcagtggagttaatgtccttggggtaaatctaatcaaaacaagatgggtccagcatataaactcctctccttcctccacccagacagattgtcctgaaacacagtagtccatactacctctcaaaatatgaccctcatgatactgaccaatcacccgggcttgataccaagaggtagctagttcggtaatacactattttattattaatagtttctcttccttctttgcccagcccgttcgtcttcactccagtttctctcaaactacactcaggctctgttttctacaga

SEQ ID NO: 66650 - DNA, 324 bp, Homo sapiens
cataaagcctgagctgggaattgcacgagatccttctactgcattatgttggccaaaaccaagtcataagactgttacagggttgaagcaaaggtcaaggatactaggaagccaatgattaaggaaatcaataaaatcggtaatatattaagtgttttacaaaagcatagaaaaaattcagaaagatgcaagctaaacatataattggggttaccttgtgtcaaattaaagagtgtggataatccttttccactttacaaacttttctattgtttaattttagtggcaaacctatatttattattaaaaaatgatttaagtatc

SEQ ID NO: 66651 - DNA, 774 bp, Homo sapiens
cagacgagtggccaactctggagcccaggctattgcttcccagtctggtggtgaatcgtccatagtctgggacaggcaggggagcccagcggcatgctggatatgaatgtatcttcagccttcaagttaccattggccagagggaagagtggccccaaactctgaagagcgctggcaaggctccccatcttcctctccctagcctccacaggaacatcacagtatggctcggccttttttttttttttttgagacggagtctcactctgtcacccaggctggagtgcagtggtgtgatctcagctcactgcaagctctgcctcccgggttcatgccattctcctgcctcagcctcccgagtaactgggactacaggcgcccgccaccacgcccagctaattttttgtatttttagtagagacggggtttcactgtgttagccaggatggtttcgatctcctgaccttgtgatctgcccgcctcagcctcccaaagtgctgggatgacaggcgtgagccacgcgcccagcctggcttggcatctttagggcagatctcagtatgccttgcattccaattcacctccagaatcctacacttcctccaaggtcagtcctcatgcgagtctccaacctcatccccacttcattttcctcattgtacttaccatcttttattcatatcccaccaaattttggctttgttagctatactgcaaatagtagatgctcaataaactactagtgaatgaatgaacttggaaaaaaaaagctta

SEQ ID NO: 66652 - DNA, 527 bp, Homo sapiens
gccagccgaagctcctcaggctcccaccctctacaagctccttctgctccagccacactcaccaggcccgagttcccacctagcaccttccctgggaatgatctccccctggttggctctttctacttattcagcctcaaatgtcatctccactgagaggcctttcctgacctgctgagcttgattccctcccctccccagtcacattactccgtgttatggtacccatccctgtctccttagcttgtttttgtctgtattggctcttccactagactgtaagttgcatgagggcagggatgtctgtttaatcccagtgctcaggatagtgtatggctcgtgatagatgcctagtacattttaaaatgagaacgaatgaagtttgggagaggctcagagcagtgagtctcccccttgttgggggactggggagtgcctgggaggggctatctggtgccagcggtttggagtggctgggatgactctggaatcctgtgaggcccagtcagtttctttggttctcatgc

SEQ ID NO: 66653 - DNA, 522 bp, Homo sapiens
attaaggttgaagagcgagtggccatttgtaggtactggtatgagatgttcctagctacccgcatgtcagccccgggaaacggcaacatttcccacccttcttaccctgggtcctgagtaggaataaaagttagtgattcttaggggcatattgagagctggcaatgatacctctcacaaatccatcccccagagataaggggtcccccatgcctttgatgtatttgggagctgtgctgtatgtgttctctttggctccccagtggagaataataacaataacaacctcgtactaatacaacccagatgtcagcacagaccctctgttctctgtcttccctgagatatctgtatcttctcagggattactgtcggttcaggcctggctcctgctttcagcttgtgggaaaactcactccatcttcattccataacctcacatctcctatgccagttcccttctctgtgctccatgctgaaccaaatgccacactcatcccctttgctttgaattatatgaaa

SEQ ID NO: 66654 - DNA, 906 bp, Homo sapiens
cattaattcataagtacgaggccggtgttaatcggcagaggtgccgtcgccccgctggagggaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggcgggccaggggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtcaataacatggtgcgagcacagaagatccaggccctggaccgtggcacagctcagtatggagccatccattcagtccattcaggtggggcgaggtcacccacagactgggtaccgagctcg

SEQ ID NO: 66655 - DNA, 1024 bp, Homo sapiens
cattaattcataagtacgaggccggtgttaatcggcagaggtgccgtcgccccgctggagggaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcccacccgcttcgcgctggagatgttcaaccgcggccgggctgcggggacgcgggccgtgctgggccttgtgcgcggccgcgtccgccgggcgggccaggggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcatgt

SEQ ID NO: 66656 - DNA, 262 bp, Homo sapiens
aagaattttgggatctgtgaaagtctgtgtcctttgagtgtgtgcacaaatataaaatgtgtacaactgtactaaataatttcacaaatttagttttgaagtttagtttcttgaagtaatactaagtaacttctgtaaataaaacttctgggtttttagaatacgattgcttgaacctgcaaggttgagactacagtgagctgtgatcccactgctgtgccccagcctgggcaaccagagtgagaccctgtcttaaaaaaaa

SEQ ID NO: 66657 - DNA, 1969 bp, Homo sapiens
gaggcggccgccaaggggccgtccagtgccggccccggtgagcgcggcagcgccctgctggagttcgcgggcggcacaagcttcggctccgagcaccaggccgcgttcgccgggccctcgggcgcctaccgggagggcgtcctgtgaggggcccggggccgacagcagcgcagcctgcagggccaccggcccctcccttggacggccggccccccgctcctcgggccccgggaggctgagggtcccagtcctgggtgcggtgccttccctcagccctcgccctgcggccccgggtctcatgcccgccgggtccgtgtgctcagccggagacgtgggggagctctggggagaagagcagcgcggaggcagcgaggccaggacgtcacccccacggagactgcgatatcccctgggtgggcccgggctgtgaagcagggcggtagttggcgggcgatgctatttatttcactcggattccgacttgggtggtctggggagcaagggatttgtgtgtttgcaaccgggtgtggcggcgagggaggggcccggccacccaggtgggccagcgggatgcctgggaggccggtgggtttggctgaccacttcttcccattcctcagtgggagacttgggccctcccggtcatccgagtctgtcccgaaggtttaactgcgcgcggcgaggggaggccttgtaggtttccaaagggcggagctccagtgggaaaacttgaaacttgtcgtctgcggatatttatttccacttcttgtatggcctgaagaatctaggaggagaaaaagccagataccaaacttacggccaggcagacgggtcgcgggtgttgacagggtcctgagggagtttgaagccttattctcgagccgcctcctcttctctacccacacttgcaccgaggtcaccccggcaccctccgcaccggttcggttttggtctctgcttgtcctctcagtccttggtactttcgtctccctcagccggaggtggcaaactcagacatctacgggcgcccgaggccctcgcagccctgagccccagctttcacttccctgggctgcccctctccgggagcaggcagacgccccgttctcggagcccagcgctcacttagagcgactgaggttggtcgaaggatctttccccacatcccataatcagggccctaggacactcgcaggtccctttaactctgcttctgtcattacactagaacaagtagtgtttctgtttagagtcccatttcacaaattggttagtggaggcacccgtggcctggcagcttgcacagtggctgtccacctcggggggggtgtggacctgagccgtggctcagtgacaaaccaggcacccaactatgcaaggcccctgcctggtgggcatcctaccctctggactgggcccatggaagccactgggcgggcagctggggtgtagttcatgtgaagccccattcccctcacgcttttggggccactgtgaatggggccaggaaacggatttttggtgcagctgcattccctaatagacctagttccctccacgttagtgtagacatggccttgggggctgagcgcagcagccaggctgccagggctgggggcgggtaggaggcacggtagttggtgggtgggaagagggcctgggtggtggcggtcagttagcctggctgggtgaggttggtgaggttgcggggcggggtggtgaggagagcaggggtcccagggaggcattggggtgctgggtaatgacctcggccctgggtttctcctctccctgcgggacaggagcctcagaaagggccaagggcaaggtgggcttggggggctctgggaatctcagctctagccctgtatggccaggatctgctgtctccgtccctcctgggccccagcagctgtcctgcagctgtcagcaggagggcctggctttaataaagagtggacaaactgaa

SEQ ID NO: 66658 - DNA, 746 bp, Homo sapiens
acgcgtccgcccacgcgtccggtttagagtcccatttcacaaattggttagtggaggcacccgtggcctggcagcttgcacagtggctgtccacctcggggggggtgtggacctgagccgtggctcagtgacaaaccaggcacccaactatgcaaggcccctgcctggtgggcatcctaccctctggactgggcccatggaagccactgggcgggcagctggggtgtagttcatgtgaagccccattcccctcacgcttttggggccactgtgaatggggccaggaaacggatttttggtgcagctgcattccctaatagacctagttccctccacgttagtgtagacatggccttgggggctgagcgcagcagccaggctgccagggctgggggcgggtaggaggcacggtagttggtgggtgggaagagggcctgggtggtggcggtcagttagcctggctgggtgaggttggtgaggttgcggggcggggtggtgaggagagcaggggtcccagggaggcattggggtgctgggtaatgacctcggccctgggtttctcctctccctgcgggacaggagcctcagaaagggccaagggcaaggtgggcttggggggctctgggaatctcagctctagccctgtatggccaggatctgctgtctccgtccctcctgggccccagcagctgtcctgcagctgtcagcaggagggcctggctttaataaagagtggacaaactgaa

SEQ ID NO: 66659 - DNA, 1894 bp, Homo sapiens
gaggcggccgccaaggggccgtccagtgccggccccggtgagcgcggcagcgccctgctggagttcgcgggcggcacaagcttcggctccgagcaccaggccgcgttcgccgggccctcgggcgcctaccgggagggcgtcctgtgaggggcccggggccgacagcagcgcagcctgcagggccaccggcccctcccttggacggccggccccccgctcctcgggccccgggaggctgagggtcccagtcctgggtgcggtgccttccctcagccctcgccctgcggccccgggtctcatgcccgccgggtccgtgtgctcagccggagacgtgggggagctctggggagaagagcagcgcggaggcagcgaggccaggacgtcacccccacggagactgcgatatcccctgggtgggcccgggctgtgaagcagggcggtagttggcgggcgatgctatttatttcactcggattccgacttgggtggtctggggagcaagggatttgtgtgtttgcaaccgggtgtggcggcgagggaggggcccggccacccaggtgggccagcgggatgcctgggaggccggtgggtttggctgaccacttcttcccattcctcagtgggagacttgggccctcccggtcatccgagtctgtcccgaaggtttaactgcgcgcggcgaggggaggccttgtaggtttccaaagggcggagctccagtgggaaaacttgaaacttgtcgtctgcggatatttatttccacttcttgtatggcctgaagaatctaggaggagaaaaagccagataccaaacttacggccaggcagacgggtcgcgggtgttgacagggtcctgagggagtttgaagccttattctcgagccgcctcctcttctctacccacacttgcaccgaggtcaccccggcaccctccgcaccggttcggttttggtctctgcttgtcctctcagtccttggtactttcgtctccctcagccggaggtggcaaactcagacatctacgggcgcccgaggccctcgcagccctgagccccagctttcacttccctgggctgcccctctccgggagcaggcagacgccccgttctcggagcccagcgctcacttagagcgactgaggttggtcgaaggatctttccccacatcccataatcagggccctaggacactcgcaggtccctttaactctgcttctgtcattacactagaacaagtagtgtttctgtttagagtcccatttcacaaattggttagtggaggcacccgtggcctggcagcttgcacagtggctgtccacctcggggggggtgtggacctgagccgtggctcagtgacaaaccaggcacccaactatgcaaggcccctgcctggtgggcatcctaccctctggactgggcccatggaagccactgggcgggcagctggggtgtagttcatgtgaagccccattcccctcacgcttttggggccactgtgaatggggccaggaaacggatttttggtgcagctgcattccctaatagacctagttccctccacgttagtgtagacatggccttgggggctgagcgcagcagccaggctgccagggctgggggcgggtaggaggcacggtagttggtgggtgggaagagggcctgggtggtggcggtcagttagcctggctgggtgaggttggtgaggttgcggggcggggtggtgaggagagcaggggtcccagggaggcattggggtgctgggtaatgacctcggccctgggtttctcctctccctgcgggacaggatctgctgtctccgtccctcctgggccccagcagctgtcctgcagctgtcagcaggagggcctggctttaataaagagtggacaaactgaa

SEQ ID NO: 66660 - DNA, 1794 bp, Homo sapiens
gaggcggccgccaaggggccgtccagtgccggccccggtgagcgcggcagcgccctgctggagttcgcgggcggcacaagcttcggctccgagcaccaggccgcgttcgccgggccctcgggcgcctaccgggagggcgtcctgtgaggggcccggggccgacagcagcgcagcctgcagggccaccggcccctcccttggacggccggccccccgctcctcgggccccgggaggctgagggtcccagtcctgggtgcggtgccttccctcagccctcgccctgcggccccgggtctcatgcccgccgggtccgtgtgctcagccggagacgtgggggagctctggggagaagagcagcgcggaggcagcgaggccaggacgtcacccccacggagactgcgatatcccctgggtgggcccgggctgtgaagcagggcggtagttggcgggcgatgctatttatttcactcggattccgacttgggtggtctggggagcaagggatttgtgtgtttgcaaccgggtgtggcggcgagggaggggcccggccacccaggtgggccagcgggatgcctgggaggccggtgggtttggctgaccacttcttcccattcctcagtgggagacttgggccctcccggtcatccgagtctgtcccgaaggtttaactgcgcgcggcgaggggaggccttgtaggtttccaaagggcggagctccagtgggaaaacttgaaacttgtcgtctgcggatatttatttccacttcttgtatggcctgaagaatctaggaggagaaaaagccagataccaaacttacggccaggcagacgggtcgcgggtgttgacagggtcctgagggagtttgaagccttattctcgagccgcctcctcttctctacccacacttgcaccgaggtcaccccggcaccctccgcaccggttcggttttggtctctgcttgtcctctcagtccttggtactttcgtctccctcagccggaggtggcaaactcagacatctacgggcgcccgaggccctcgcagccctgagccccagctttcacttccctgggctgcccctctccgggagcaggcagacgccccgttctcggagcccagcgctcacttagagcgactgaggttggtcgaaggatctttccccacatcccataatcagggccctaggacactcgcaggtccctttaactctgcttctgtcattacactagaacaagtagtgtttctgtttagagtcccatttcacaaattggttagtggaggcacccgtggcctggcagcttgcacagtggctgtccacctcggggggggtgtggacctgagccgtggctcagtgacaaaccaggcacccaactatgcaaggcccctgcctggtgggcatcctaccctctggactgggcccatggaagccactgggcgggcagctggggtgtagttcatgtgaagccccattcccctcacgcttttggggccactgtgaatggggccaggaaacggatttttggtgcagctgcattccctaatagacctagttccctccacgttagtgtagacatggccttgggggctgagcgcagcagccaggctgccagggctgggggcgggtaggaggcacggtagttggtgggtgggaagagggcctgggtggtggcggtcagttagcctggctgggtgaggttggtgaggttgcggggcggggtggtgaggagagcaggggtcccagggaggcaactctacggtgttagtacgtctcggtttctccatctctgcgggacag

SEQ ID NO: 66661 - DNA, 1996 bp, Homo sapiens
gaggcggccgccaaggggccgtccagtgccggccccggtgagcgcggcagcgccctgctggagttcgcgggcggcacaagcttcggctccgagcaccaggccgcgttcgccgggccctcgggcgcctaccgggagggcgtcctgtgaggggcccggggccgacagcagcgcagcctgcagggccaccggcccctcccttggacggccggccccccgctcctcgggccccgggaggctgagggtcccagtcctgggtgcggtgccttccctcagccctcgccctgcggccccgggtctcatgcccgccgggtccgtgtgctcagccggagacgtgggggagctctggggagaagagcagcgcggaggcagcgaggccaggacgtcacccccacggagactgcgatatcccctgggtgggcccgggctgtgaagcagggcggtagttggcgggcgatgctatttatttcactcggattccgacttgggtggtctggggagcaagggatttgtgtgtttgcaaccgggtgtggcggcgagggaggggcccggccacccaggtgggccagcgggatgcctgggaggccggtgggtttggctgaccacttcttcccattcctcagtgggagacttgggccctcccggtcatccgagtctgtcccgaaggtttaactgcgcgcggcgaggggaggccttgtaggtttccaaagggcggagctccagtgggaaaacttgaaacttgtcgtctgcggatatttatttccacttcttgtatggcctgaagaatctaggaggagaaaaagccagataccaaacttacggccaggcagacgggtcgcgggtgttgacagggtcctgagggagtttgaagccttattctcgagccgcctcctcttctctacccacacttgcaccgaggtcaccccggcaccctccgcaccggttcggttttggtctctgcttgtcctctcagtccttggtactttcgtctccctcagccggaggtggcaaactcagacatctacgggcgcccgaggccctcgcagccctgagccccagctttcacttccctgggctgcccctctccgggagcaggcagacgccccgttctcggagcccagcgctcacttagagcgactgaggttggtcgaaggatctttccccacatcccataatcagggccctaggacactcgcaggtccctttaactctgcttctgtcattacactagaacaagtagtgtttctgtttagagtcccatttcacaaattggttagtggaggcacccgtggcctggcagcttgcacagtggctgtccacctcggggggggtgtggacctgagccgtggctcagtgacaaaccaggcacccaactatgcaaggcccctgcctggtgggcatcctaccctctggactgggcccatggaagccactgggcgggcagctggggtgtagttcatgtgaagccccattcccctcacgcttttggggccactgtgaatggggccaggaaacggatttttggtgcagctgcattccctaatagacctagttccctccacgttagtgtagacatggccttgggggctgagcgcagcagccaggctgccagggctgggggcgggtaggaggcacggtagttggtgggtgggaagagggcctgggtggtggcggtcagttagcctggctgggtgaggttggtgaggttgcggggcggggtggtgaggagagcaggggtcccagggaggcattggggtgctgggtaatgacctcggccctgggtttctcctctccctgcgggacaggagcctcagaaagggccaagggcaaggtgggcttggggggctctgggaatctcagctctagccctgtatggccaggatctgctgtctccgtccctcctgggccccagcagctgtcctgcagctgtcagcaggagggcctggctttaataaagagtggacaaactgaaaaaacatactcccttactttacaaaag

SEQ ID NO: 66662 - DNA, 405 bp, Homo sapiens
ccctgggccagagggatctgaagttggcgaggcggacggagaggcggaggccgcggccgaggagagagaggaggcggcggtggcggcgcccacccccagcggcaaggtggaccccgcgccggaacggcgcttcctggagctgggcaacggcctgggggagggcgaaggcccctcctcccacccttggggtgctgggtaatgacctcggccctgggtttctcctctccctgcgggacaggagcctcagaaagggccaagggcaaggtgggcttggggggctctgggaatctcagctctagccctgtatggccaggatctgctgtctccgtccctcctgggccccagcagctgtcctgcagctgtcagcaggagggcctggctttaataaagagtggacaaactgaa

SEQ ID NO: 66663 - DNA, 824 bp, Homo sapiens
gcaaaaagaaaatcagcaaatctcatttagaaaaaaaaaaatagttcctgaaataaagatgttgattttcttaaagaaaagataatattctcaagagaaaagggtattcctgaatctattttctaacatcagtctgtctctcagatgaatagagaattccatgtaattggggaatatttttgtgcttttagcaaagatggaaaacagcttcctttctcctcttcttttcatgtcatccttggagcattcctttaatgccccatttttctgttcaagagggtatgaaattaagcaggtggagtaagaacttcctggttatgcattaacactgattaaaatgcatagcccagaatggaatcccaccattatttcaaagtcaggatctctgcatttttccagtactatttttgggcaggaaaggatgagactagacaacttccaggatcctctcaaatactaacgttctattatggaaaaggattgtcaatgacagtacctgttctgagggaagataaggatcagcggtgtgcaaacctggcagagatgcagttccattcaaaagagacttgcggaaaacctaccatgtgctgggcatgagataaggcattgcagggcatagaaagaaaagcaaaaagtacttcctgtccttgaggttactatctcaaagtgaaaagagactactaaaaataaaagctttactactatgacaatactgaatagaacttttacatttgcagattattccagtatctcaaatggcaataaccctgtgattgaattattactgcctctacaacacagggaaagaaattcagcacatagag

SEQ ID NO: 66664 - DNA, 465 bp, Homo sapiens
gcagctcgccgtcgagtacttttcctttttccatattggaacaactattcattgtactttagaacacaaattaggcttttttaagaaaaacacatccttcatataagtttttcataccaaaaacatgtcttatattccctgaataagagttttttcccttatttctattttcaattacaatatgataattagaatttttaacttttaataatcttatcttctagtgaaaacccaggaagtgttgtgggctgtcctatatgagcattcaccagttcttaatttctagaaccgtgttttctcaactttttatatctattaatagactcaaatacatatagctttttatacaatacaaaaacaagatgccaaacatgtatatattctttaaacttatgttcagcaattaatgtttcagtattctaattttcttagaaatgactcagatgtttcgtgtctgttatttaa

SEQ ID NO: 66665 - DNA, 1375 bp, Homo sapiens
atgcagtgaggcggaaaggctctcgccggggcacagaaagatccccagggccgcaaggcgtgctgtcgcctgcaaaggcactgacccacgagcccactgcctccctccttcctgggtggagcaggggcctgccttcatctccaaggcccgggggctccggcatctcgacgcggcttctggcgacacgggcaaagagagacagaggctagtccgagccggagccagtgtgaccacacgtggcactgacgtcccccaagagcacatgcagtgagcctgtgtctctgaggccgtagtgggcgacgacgagacggacagtgatgtccaggcctgcgcccgggggccactggagacctgcccctcaaagcggaggaaacgccaagctcacctgaaaacctgcgagacagggcctgtgcacgagtccagtactcctacttcgccaagtctcagggacccatccccgagcaacggtggcggcgcagagaagagcacggcgccggcgcaggtgcagagagacaggaggctgatggggggaagttgaggcacctggggcagagaaaaaaatgcattgccaagaggtttctgggtcatctactgacgaaaatgtcttcccatcagcccttgcgctggtccccagggaccctggcatccgtcgttggcgcccagggtgcgcgtcgggccactaggggtaccccaactcggacagaaggcccatgagttgaatttgaagtttgtgggaatagaggtgaggcaccaggggcagaaaaaaaacaggagacctcgcctcagacaagcggggcctgggtcccccatggatgaaagtgccttcccattatgctgtaccctgggcagagtggacagtgacgaccctggttcgagcccagggtgcgcttcgggaccgcttgcggttaccagaaagtgaacaaatggtccatgagcggaaggtgaggcacctgaggcagagaaagtaaagaaacgcgccgccgagaagcagtgcctgggtccctcacggaggaaattgtcttctccttagcccgttcgcttggcagtgaggtccctggcgtccctggtttgatcccagggtacgcctcgggccactagtgttaccccaaggtgggcagaaagcccataaggggaaggcgaggcacctggggcagagaaaaaaaaaacttcgccgcagagaagcgcggcctgattccccacggacgaaagtgtcttcccatcagtccctgcactgggacccggggaccctggtgtccctggttcgagctcagggtgtgcctcagccgctacgtgcaccccaaggggagctttgggagcacaaagcccatgagggaaagtgagttttgagggaggagtggtgaggcacctgtcacag

SEQ ID NO: 66666 - DNA, 199 bp, Homo sapiens
gaatcttcactgtttataatgtatagcaaagtctttttttccaaagtgggaatacataataaggatgttactgaaattgggaaactctcatatattaaataccacttaacagctagtacttaagggaatgagtcaaaatttcctgaaaaccaggttagcatagtatagtatgagacatctaacataaaatatacagctg

SEQ ID NO: 66667 - DNA, 457 bp, Homo sapiens
cttccccaccctgaggagaggacaccatggcttactactcaggacaagtatgccccgctcagggtgtgatttcaggtggcttccaaacttatacgcagtttaaagatggtggggacagactttgcctctacctagtgaaccccacttaaagaataaggagcatttgaatctcttggaaaaggccatgaagaataaagcagtcaaaaagaagtcctccatgttggtgccaagggcttgcgaggggaaataaaaatgttatccagcctgaccaacatggagaaaccccgtctctattaaaaatacaaaattagcctggcatggtggtgcatgcctgtaatcccagctactctggaggctgaggcaggagaatcgcttgaacccaggaggcggaggtcgcagtgagccgagatcatgccagtgcactccagcctgggtaacaagagtgaaactccgtgtc

SEQ ID NO: 66668 - DNA, 354 bp, Homo sapiens
tcatagctgaagtattaatttaattaaataaatcatacaaaaaacatatgttaaaaattgatttgcctttatggatagcacttagaaaagttagtattgacaactaaaatgagtaactgaggcatatatctcaatcactgagttttattaagtcagctttacggtacatctgggaaaggtttagtatttataaatttcctacagggaccaaaggtatgtagcagaaggggcaggtaggtgataaggtgaatagttacattcctgtgagactttagttaatacccagtaaatgtacattttacataagttaagtgaatgtctgcagagaagagagtaaaggaagagtcaattata

SEQ ID NO: 66669 - DNA, 413 bp, Homo sapiens
tgtagtcaataaaacttgtattaaaattcttttttaaaaatttgtatagtaattacagtgtgaatattaatgaataattttctggatagagtcatgttttgcaactatgtgttaagcataacataaccttaatcttcaggttgtaaaaatattttagataaataacagaaagtgatctttattttggatggttatagacagacaaaataaatgatatttaatattatatgacggtgataaaaatacatatagtgatttttaaaataaatgccacctttgaccttactgtggttttttgttgttgtttgttttttaagagacaggttcttgcactgttgcccaggatggagtgcagtggtgtgatggtatcttgctgcagccttgaactcctgggtgcaagtgatcctcccacc

SEQ ID NO: 66670 - DNA, 634 bp, Homo sapiens
gtaacttacaactgaaactttggagtctgtaatctttctgtgtgttttttttttctttttaagacgattcacctggtcacttctatcactgggtgaagctgattgtatataagctagatctgccttctgcctacctttatgttagtactatttttacgtttaattttgcccaagttgaaagagattgcttggttcatggggccttaaacatttcaacatttgtccttcacaagataattatttcattaaaagtaaattacaatttattcagtagctctccacatgaaaataataatcagatggtaaatggatgccctaagatatgtggagaacaaattaccgtggtattttaaaggagagagttttctaagctaacttttatgcatgcagcatctccctggctaacatgagcattgatgataatttctaccattaatgagctcatttttttttttaatgagactttgtttttacttttaaaaaacagtaacctaaggcaggtgaagtcaaattgttattgctgggaagttgtgtttcaaatgagcactgtaaatgattttgttgagcaggagaatggcctgaacccaggagccagagcttgcagtgagcagagactcgcgccgctgcaccccag

SEQ ID NO: 66671 - DNA, 186 bp, Homo sapiens
cccttcatgtgtccctggcctcagactgtctccttgccagcctccaggagtgagtgattcctcggaccccttggaggaacacagctctggggactattcgcctagaaggtgggagggggatggaagatgctgtgaagtgtggggatgcagggagtggagtggttccagggaacagtttccccacag

SEQ ID NO: 66672 - DNA, 191 bp, Homo sapiens
gtgtctcttagaggatgactataattaaatatcacattttcttttttagcctaatagtcagtttggttaattttttgtgttctttttctgactttcctaattacctttcttttgtcctgcagagaaaaaaaaatgccttcaaaattaacaatttctagcttcttagtaattttatctttgagttaaatcaa

SEQ ID NO: 66673 - DNA, 455 bp, Homo sapiens
agagatcctcccacttcagcctcccaaagtgttgggattacaggcatgagccaccttgcccagctgtgaaacttttggagacagagtctcactctgtcacccaggctgaggtgcagtggcgcaatctcggcttactgcaacctctgcctcccatgttcaaacaattcttgtgcctcagcctcccaagtagctgagactgcaggtgcgcgccaccacatcccactaatttttttgtattttagtagagatggggttgcacaatgcccaggctggtctcaaactcttgagctcagacaatccacccgcctcggcctcccaaagtgctaggattacaggtgtaagccactgtgcctggctcagctgtgaaactttaaataacacatttaagttgcttaacataatgcctgacatatatagtgaccgctcaataaaaggtaaccatttttaacctctta

SEQ ID NO: 66674 - DNA, 400 bp, Homo sapiens
gctgtttcagtgttttgctgtttattttaaaaattcatcattaattcagcaaatattgattgagtgcctaataggttccaggcactgtactaggctttagggatggaaagaatgttgaaaaggtcaagtatggttcctgccttcatagggtcatgtagactaattggggattagacaagtaaacaatgatttgaaagcatttaaaaattctgcagtgagtcagggtcatttggtgaacatataagtggaataaaaattataatttgatagctgggtgtggtagtatgctcttgtagtagtcctaggaggtttgtttgagcctgggaagtggaggctacagtgagtggtgatgaagccactgcactccagcctaaaggacagagtgcagctctgtttgaaa

SEQ ID NO: 66675 - DNA, 424 bp, Homo sapiens
ctacaaagaacttaaaactaagtaaggacttcaaaaaagaaaggtggagagaggggaaaagatgactgctacacattttccctttgcttcccacgggaatggcttcattcttgccttgagtgtcttagatatgtctctcccccacccgcagcactggcttttctgtcttttaccattgaattaggcctggtctagacttcagtatttatacctgagagtacagaaaagaggcttttcaagaatacgtcagttctgttagaataagatcccatccgtcatcagatacctttctacagctttctgtcacagtatttgatcactgatcatagaacctggactagagatttcatgtggagaatgtactcccttcaaaaggaaaaccattcaacaatttaatatttaattgattaaatacatgtgattt

SEQ ID NO: 66676 - DNA, 418 bp, Homo sapiens
gagaagagaaaagtagaaaatgaagcgtatgagaggttgataagtgtcagagaggtaacaagggaaggtgggtagggagagtgttgggagtcagggataatgatggtgtggtggattgtccaaatttaggtagtgtgttctgagaaggcctctgaaaaggtgacataatatagcagagtcttgaagatgctttatgtggatatgatttgaggtagagcagtcaatttgttagagaatgtaagttgtcatttttggatctgggtcatgtggttcactgaaattaggagggctttggatacacaaggagaaatagaaattgtctatatgtgtttaccaggtagtgtgcttgaagtcatccagtaagataagatgtttcttcacacttgaagatgaccttatttcccacctttatttaaga

SEQ ID NO: 66677 - DNA, 500 bp, Homo sapiens
actctgtccctttatttctcaagccagccgacgcttaggaaaatagaaaagaacctacatgattatcggggcaggtcccccgatatctggcgcccacgtggtctttcttttttcctaagtgcatgagggaacccgattccctttggtaggtgcggtgaaacatcaatcggcttggtccacagataagcgtgttcaactccccgacgagtggacaaaatatgaaacaccaagaaaaagagaaggaaaaaaaggaggaaacaaccacatatgtcacctttccaagagggactgaaactgggctgacccttttgatttccaaactcagcgttttggtgtaaggcggccaaagaaggatgcggagcccagcactgtgaagcctacaaaaacattgatgcgctggcttggggatttgaatttgaacatctttcacactaagttcagactcatgaaaccaatcttcagatgctctgtaaaccacataataaagagtttggaaatta

SEQ ID NO: 66678 - DNA, 743 bp, Homo sapiens
  misc_feature (722)..(722): n is a, c, g, or t
tgtgacgttccctacgcggtcgggcgttgggtttcgcggcgctcgccgcactggttgttcagcaccttcggtccggttgaggttgtcaagtcggaccaaacaggttgtttctctgcagtttccaacatggcagggaggtttaatagacatggataagaagtccactcacagaaatcctgaagatgccaggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaaggacaaaatatgaaacaccaagaaaaagagaaggaaaaaaaggaggaaacaaccacatatgtcacctttccaagagggactgaaactgggctgacccttttgatttccaaactcagcgttttggtgtaaggcggccaaagaaggatgcggagcccagcactgtgaagcctacaaaaacattgatgcgctggcttggggatttgaatttgaacatctttcacactaagttcagactcatgaaaccaatcttcagatgctctgtaaaccacataataaagagtttggaaattaaaaaaaaaaaanaaaagaattctccagacgcgt

SEQ ID NO: 66679 - DNA, 829 bp, Homo sapiens
tgtgacgttccctacgcggtcgggcgttgggtttcgcggcgctcgccgcactggttgttcagcaccttcggtccggttgaggttgtcaagtcggaccaaacaggttgtttctctgcagtttccaacatggcagggaggtttaatagacatggataagaagtccactcacagaaatcctgaagatgccaggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaagagtcttgtcctgttgctcaggctggagtgcaatgatgcgacctcggctcactgcaacctctgcctcccggattcaagcaattctcctgccacagcctcctaagtagctaggactacacgcatgcaccaccacacctggctaatttttgtatttttagtagggacggggtttcacctggttggccaggctggtctcgaactcctgacctcatgtgatccgtccacttcagcgtcccaaagtgctgggattacaggcatgagccaccgtgccctgcctcttttagttatttttaaatgtacaataaattgttgttgactgtaatcaccctgttgtgctataaaatacgaaatcttatacattctagctatatttttatactcattaatcatcctcctttccccaccttcaa

SEQ ID NO: 66680 - DNA, 849 bp, Homo sapiens
tgtgacgttccctacgcggtcgggcgttgggtttcgcggcgctcgccgcactggttgttcagcaccttcggtccggttgaggttgtcaagtcggaccaaacaggttgtttctctgcagtttccaacatggcagggaggtttaatagacatggataagaagtccactcacagaaatcctgaagatgccaggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaaggtgcggtgaaacatcaatcggcttggtccacagataagcgtgttcaactccccgacgagtggaaagggaattccctgaccccttgaacttcccgggttaggtgatgcctcgccctgcttcggctcaagctcagtgcactgaacccactgtcctgcaccaactgtccagcactcccctgtgagatgaacctcgtacctcagttggaaatgcagaaatcacctgtcttctgtgtcgctcacgctgggagctgtagactggagctgttcctattccaataaaattgttctttaatcaacacaattgataaacctttagctattctgagcaagggaaaaatatagagaaaagacacaaataccaaagttaagagtaaaagataggacatcactaccgactctatggaagttaaaagtattataagggaatatt

SEQ ID NO: 66681 - DNA, 319 bp, Homo sapiens
ccagcaccgatcccgacatagatcagtgacgtctttttcttcagatgatcctatgtttccttcttcctcatcatcgtcttcaggaagccagacagattcaagtattgaaggtatgtttatcatcctgttaaggtttcatatttataagttaggtgatttagaaaaaaaatactaaacatgttataatttttgtttattcaactaatatttattgagcatactcactatgtaccagacataatggtaaacatgccatggtcccttcagacaaggaacttttattatattaagcaatattaggaatgatagaggagttaaa

SEQ ID NO: 66682 - DNA, 710 bp, Homo sapiens
tgtgacgttccctacgcggtcgggcgttgggtttcgcggcgctcgccgcactggttgttcagcaccttcggtccggttgaggttgtcaagtcggaccaaacaggttgtttctctgcagtttccaacatggcagggaggtttaatagacatggataagaagtccactcacagaaatcctgaagatgccaggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaaggacaaaatatgaaacaccaagaaaaagagaaggaaaaaaaggaggaaacaaccacatatgtcacctttccaagagggactgaaactgggctgacccttttgatttccaaactcagcgttttggtgtaaggcggccaaagaaggatgcggagcccagcactgtgaagcctacaaaaacattgatgcgctggcttggggatttgaatttgaacatctttcacactaagttcagactcatgaaaccaatcttcagatgctctgtaaaccacataataaagagtttggaaatta

SEQ ID NO: 66683 - DNA, 819 bp, Homo sapiens
tgtgacgttccctacgcggtcgggcgttgggtttcgcggcgctcgccgcactggttgttcagcaccttcggtccggttgaggttgtcaagtcggaccaaacaggttgtttctctgcagtttccaacatggcagggaggtttaatagacatggataagaagtccactcacagaaatcctgaagatgccaggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaagagtcttgtcctgttgctcaggctggagtgcaatgttgcggtgagctgagatggaccactgcactccagcttgggtgacagagtgagagtccatctcaataagaaaaaaattctattgaagaactgagtgatttttgattgtggcataaagcaagcaaaagttaatgcatacttgcgagatttatgggtagacaacagtttggcgtatggataaatcttgcaccatatttgaatgtccttaggaaagaagggcagaagaattcaggctctggtgtgactcagggggatgggaatggatgccgccggtaggatggtcagaggtctttgggggtgaaggttagttgggggggcaaacagaaaaaatttgggcggcgaattaaattggggcgggaaggtgtga

SEQ ID NO: 66684 - DNA, 768 bp, Homo sapiens
tgtgacgttccctacgcggtcgggcgttgggtttcgcggcgctcgccgcactggttgttcagcaccttcggtccggttgaggttgtcaagtcggaccaaacaggttgtttctctgcagtttccaacatggcagggaggtttaatagacatggataagaagtccactcacagaaatcctgaagatgccaggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagacagattcaagtattgaagatgctgccaagggaaaaattaagaagaagagaagagagaaaacaaataaatgggaaaaaagaaaggacaaaatatgaaacaccaagaaaaagagaaggaaaaaaaggaggaaacaaccacatatgtcacctttccaagagggactgaaactgggctgacccttttgatttccaaactcagcgttttggtgtaaggcggccaaagaaggatgcggagcccagcactgtgaagcctacaaaaacattgatgcgctggcttggggatttgaatttgaacatctttcacactaagttcagactcatgaaaccaatcttcagatgctctgtaaaccacataataaagagtttggaaattagatgcggccgaagccctttttcccgttccccgttttcatcggggcgggggaggtgagg

SEQ ID NO: 66685 - DNA, 333 bp, Homo sapiens
cagatatggggagccaactgaattgtttttcttgtttatctttcctatttattattctctttttaatttttgacttttttgaacttttctttttagaaatatgcttacccatgaatttattgaaaaccaaaatgtcattattttaaattagtcctattcttattggatctgattttttggggggaaaaaacttccttctttgataaatacatttcattcttctttctcatgtttttaaagaaaaaagtagtattgctatctctcgtggcctaaattgagagagatgtctttggcaatgaataacctctccttgtttgaatgacttttttttaa

SEQ ID NO: 66686 - DNA, 3549 bp, Homo sapiens
  misc_feature (467)..(467): n is a, c, g, or t
  misc_feature (974)..(974): n is a, c, g, or t
  misc_feature (2770)..(2770): n is a, c, g, or t
gaaggcagcatgaggtcagcacacataattcaattcaaagtcatcagacttcattttttccctaaaaagttgctgaaaacagaggaagaaggaagaatgcaaggaacaagaaagaaaaattgccagagctttaaatgtcaaagaataataaacacacaggagcagatcattccggcagccagccttggcttcgttttcttttctcctgtcttccgcatctctgctggtgctccactttgtcacatacagtttttgttcccagatcttagagttttatctttacagatgttcctgtttatttcaaagaagttatgtcacttttctcttccccccccaagatggtacccaccttattgtagaaggaatgttatcttcgaagcccttctcgcctcttagactcaggtgtgcctctattgtaagaggcaaaagtccacgttctcgtggcctccttctcttgctttccacangctgctcagctcactgtgcttcttctgggttagccttcttgctatttcttaaaaacctcctgtttcttacattaatggcaatcaccttgcatcaacctaatggattctgtctcaggagtctttgcacctgctcttcccactaactgggatgcatttctgaggactcacatgatctcctaacggtctctcgcacccgcacaggttatttgagaatctgctcagatgtcaccttgtcagaaaggccttctttgaccaacatctataaaatatcccttaatccaactcctttcctctccttttattctttctttttttcctctgaagatggggccttcctatgtttctctggctgctcttgagctcctggtctccagcaatcctcccaccttggcctcccattgtactgtgattgcaggcatgagccaccacacacagccccttttatttcttttgatagcgctactcattacctggcatgacagcacatattaatttgtgtacgtctanactttttataatgaaggtgtcacaaaatcctgaactgctagtgcaggggtctatgcattaggggctccagagagaacccttctgccattgtgacacgcccactgaagtcccagagtctatatagagtaggtgcccaataaatataactgaatgaatgaaggtttctcacttatttcattcatttcttcgcacttggattccacttcgttatagagacttctgttaagtacctgtaatcaaaggactttctttttggtttgaactatgtgatttgttgaaaggctgaggagggaatgagcttactaaaccgtactccctgtcaaaacatttattggctttaccacacacttagtgagaccctattgatgctgcattttgagggcactaaaaactaataagccagaagaagtggccggcatatgtggtctaatagattcaaggttgaagaatccgcagcgacggtaatttgcacaagtcaataagtacttcctagattgtctatattttttaagatacagagtttttatacctagttgagaaacaacaaaaatatgtacttagtgttctatcgtccatgcatgctttatttccaatgaaactcagaggaaataggtatttccaacagtgtttgccatagttacacccttttctagggctctgctcattttattccatttcacactcatctttttctgttgagaacctatagaaataatacaagtaagtaacatttattgtgcactttctatgtgcccggcattgtgccaaggccttttcatgtatttcctcacttaattcctctactcaattaggcaggtaaaataatatagttctcattttaaagatgagaaaaccgaggcttagaaaggctacacagtcaggatataaagccaggtctgtccaatttccaagcctccacttgtaactgcctggtagaccctctcctcgacttccttttccttttttttttttttttttttttgagatggagtctcactcttgtggcccaggctggagtgcaatggcatgatctcagcccactgcagcctccacctcccaagttcaagcgattctcctgcctcagcctcctgagtagctgggattataggtgcccaccaccatggctggctaatttttttatttttagtagagacaggtttcaccatgttggccaggctagtctccagctcctgacctcaggtgatccacccacctcagcctcccgaagtgctgggattacaggtgtgagccaccatgctcagccgaccctctcttctacttcctgaggcccatacaatcaaaatcctctggcacctggaaccaggtagaaatgataggtagaggtgtagaagtcttacagttaccccaaacccccacagaggcatgtccctaataatatatttgtaaaccgacaaaagaaaactagctttcagaataacacagaaaatgaattattggctgctacaaaaatttaggaatctggagatcttgggggcatagatgaggttaaccaagcagcacctgggtcccagcccaggctacaggccccaaaggaaggacatgaggacagaacaaggaggaatgaggtccaggaaagagctgctcatcagatcccaggattttaaagtatgctgagtgctttcttcctattaccctgtagttccagctttgatctgaagggaagaagttggttcccttctaaactagatttgttttatgacctaaggcatattcatttgggcaacatgagtatgacatttttctcccaaccatgttaagtctaattaatttatcangcacttgccagtttgcccattcttgcccataactaccctcaaatcttcaacttttaaggtgaatttggttttgaagttactgtcatttcttatggcctactggaaattttctggtgtgtgttttttttttttaatgtttgcattttctaagactactgtgcttttgtatgtattcatttaaattgtcaaaaaggatgttgtcaagatatgctgaatgagccccttcccccagaaatgttgccatattaatgggatattagccctttactgacttggaggttgcatcttctcaatccggtaattagctgaagtgctacattttaaaaaataatttaagctcttttttcattatttttttttcaatttttcagaaggcaagttcagacacataggtttatacaagatgaaaatattagataaaaagtgatacatctgaattatgtattttaaacatttttacttaaataccacacatgtccacatagcattatttatacacattttagtaaaactagctgagggtgcttgggggtagggtattcagttagtaacctgtatctaagttgatacatatcttccctaacctgtttacttgattgaattgattagggactattaaaaaataaaattatctttgagaagcaaagagtaaacacatatataacatggttctagttcttgtactggactcaattcagtctgtaatttttactgagtccctacaaaggccttatgctatgatgggtgctaccgaagatacatccgtagtttttgttttt

SEQ ID NO: 66687 - DNA, 393 bp, Homo sapiens
ccccacaggctcagaaggcaatagggaaaatgtttccagggcatgtcagagactttcatggcagctgctctcattacaggcccagggactaagataaaaaactagtattttggggctggcccagagcacccctagagactttgttccttgtgtcccagctgctccagccatggctaaaaaaggccaaggtacagttcaggccacggctctagagggtgcaagccccaagccttggtagcttccatccttcctgcaggtgcacagaagtgaagaattgaggtttgggaatctctgcctagatttcacaggatgtatggaaatgtctggatgtccatgctgaagtgtcctgcaggagtggagtccccatggagaacctctgccagggcactgcag

SEQ ID NO: 66688 - DNA, 3314 bp, Homo sapiens
  misc_feature (3308)..(3308): n is a, c, g, or t
  misc_feature (3310)..(3312): n is a, c, g, or t
  misc_feature (3314)..(3314): n is a, c, g, or t
ctgggacctgtccccaggggaattatttctaatacccttgataaaatgtacaaagctagggtaggaagtagcaaggtgacagcagtggttaggtggaaagtttctctaagagaaagaactaatgaattcgttcaattgaagctttttaaatatatttattcctgtcacctttcaagtcagcagctttttccaggtgacatggcaaaagggcctggcaagtgcacagggttaagccaaggactatcaatactgctccctaaaatattttcacctctggttttggggatctgcttcttctcggggtctctcctgctgctttcctggtaatagcacctaagagacccatgaaacaaatccccagttcaatacaaatttatagctgagtaaatatgagcataggctttaggaatccacagaattggagctttgcttaataccagccgggaaaatgtggttgtcagttaacctctcagagcctcttcgaggcttggttcgctcatctattaaatgagtctgaataagccctactcctccaggttgttgctagcatcagacgagaaatgtatgcaaagccccagtgccatggctgacacacaggaaacattcaacaagtggtagtgcattttcactaagtaaaaggagtaatgatttctttagtggtttcttttaacacaggggtttctatccatcccaaatagaggatagatattctaataaaacaatcatttatgtgatttgtgattacaccgtacaactcaagttcctgtggaatgtttagcgtaatcaatccgaagctctcagcaagctccctgggcctgattttcaaatccaatgttactgtagcaaagaactaaaggaggggaagaaaagcaccactgtattaaatacaccctcctcccctttttcctaaaggctgtttgtccccttctcttgataaatcttcagttcccagagagcagagactcttgggaaacaggaagtagcaaaatgccagtgagaaaatccccagatgaagagcagcaacaagtctccgggcaacagtgtggtcaaaagggggaaattcccccatcagcgctcaaaaacagtccctcaggaaagcttagtgaaggttaatttgggaaattccctcagaggccatagaacagaaacggaaaactgctgtttaagagaaatctgaacggagcaagccagttcgtggctgcctggggtgctctctgcgtgaaccgcgctgctgctccagcctgacttcccccttttcatcctgatcctgagggcaaccccgaaggggtccagttgccagagccacttgacacccaccctgcccaggctcccaacccaggagaattaatgccgcaacacccagcctcttgaaacgagctgctgctaaagcagatttgcctccccgttaggacctcctgtgacccaccctcattcctgtccccatggtagactagcaagccacagtcatcatactgtgagtgtccctcacagtcacttgctataacaagtccatcaggttttactgggttttaatctaaatgtgaccttaggatgacatttcttagtgctgctaagctccaagaggcagggaggaatcctccccacaaagaagaagaaaaaaaaaatcacataaacattgtcccatgaaaggcttagaatggaatatcctctgatcagctgaagcagagaaagcatataaacactgctggaaagggggctgggtcaggggcaagtactggctctacagagccctgatctccagatgcaagcgaggcccagttccctgctgcaaccagctctccgtgaatcatttccattcccataaaacttctatttgctgttttgttttgtttttttatgtgtgacttaaaatgaccatttcaagaagatgacaaaaaggagatttcagtagaagagagaggaaagtagactccatcatgacagcctaaatttgttttactgtacacttacgcaaaataggtatcaaattttggaaaagagattttaaaggagaaagtactctgggtttaaaattctattaaaaaatatgctctactagagcgtgtgtgccttttttatgtaatcaggacccactgctgtatgagtcacaattatagattctactttcaaatattttttgactcctagaaaacagccctgacaaaaaccacttttctgatgtcttcaaacaaacagctactttcaaagtctcctacacttgaaaattctagacagactgtcaacatactctcaagaagtattctttccatttttcttctgggaaaatagcaggaattttggcccctagggagaaatgcagaaggagtagcaaatgagcacactgactggaaagaatgctatttgtctttcactatgtggagttcagaagagcactggccattggcgaagtcccagaagtgaaggtcaagttacagcttaatctgggctcataccctgcaactgagtccaccttcagatggtgcttccactaagaaagctgtgggatgcctacgctgcattcattagaccctagcaatataaatattgctcgtttccactagggaggaaaacaactctgctgtcaaatttgctgagcacaaagtgaaaggaagtctgcaatctgttggctaattaagacccattaaatctgtacttggatcatggaagcttgtagggactagccatgtcagtcccaccttgaagacagagttccaggctggattgcattttctagaacaaatcctttaaatattttcattcaaagagaacagtaatgacagcttccaacaatcaaactgaatattttagtagaagcttttctagacatttgtgttgggataactaatggaactaatagatttaagaaatttcagaactcctaattaagccctggatactgcctcagattctgaatgactgaatatattgggcattttatgcctcatccttcatgtagtccaacaaacacctattctatatttattctaaaaaactttactaaaaactttactaatattaaattttctaaatactttctaaaactttactaatattaaattttttacttaagatcttcagaaaattttccaaattttataaattgtatacatttttgatgctgctattgctatagatgtcttctggaagttgagttgtgcctttaggaatattttcccactacatcactgtaatgagtgttacaaaaaaagtctctgtacattctgcatgccttgattaaatgtattaattttctaccaaatcactattcctataagtgtttaaaataaaaatgaatatggtcttcaaanannnan

SEQ ID NO: 66689 - DNA, 371 bp, Homo sapiens
ttcctgagtttcaccctagacttccagaattagaaattccagaggtggggactgggaatatgcattttaaatgtcctcagcaaattctgagacacaatcaagcaagacaattatttaataaccttagtgtctttcctctccaactgtacatacctgaagactccatcctacttgtagaaaaggagataacaaaggttcagtacctggcatttacaaggacctcaatcaatacttgttccctgaatcccttcttaaaggaactgtggacttcaggagccagaagacaccagaggtccctttccagtcccttgaagtaaaataagtctgaggctgtctctaatcacctccgcacaccgagggcctaatccatc

SEQ ID NO: 66690 - DNA, 893 bp, Homo sapiens
ctccctcagctgagacttctgtgacaaatgccacagatacacagattaaacaacagaaattgatttctcacagttctggagcctggaaattcaagatcaagctgctggtcagtgctgttcctagtgaggtctctcttcctggtttgcagacagctgccttctcattgtatcctcagacggtgaggagagagagagagtgagcaagctctcttctctcttcttataaaggcactaacctcattatagggccccatcctcataaccttattacctccgagtcctcacctcctaacaccataggaggttagggtttcaacattttaattttgataaatattcagttcataacaggtctgcacctggggtccatataggtcagttttatttccagcagaataatggtgatctgtaccaccattacacctgcctgtatgcaggcaacccatattcatggctttccataaatggctttattctttccgaaaatggcatttttatttcgcttactgtgtgtgtgattaataccttctcatggttcaaaataaaaataaccaaaaagtcccctgctggctctgtgctcagcctcctacaacctcaccaggagcagccagtgtgaccagtttcatgcgggccctagagatattttatgtagttacaagcaattgcatatgtatttcctgttttggcataaatgttagcacaccatacatacgttgttctccatgttatttttatgtaataagttggagatatttccatatctctagaaggaaggagatacgaaaacaaagaatttctttttgtgtgtgtgccacaatagcaaagaaatttcttcattttttaatggtaaaatacacgtaacataaaattcaccattttaaccattttactaa

SEQ ID NO: 66691 - DNA, 360 bp, Homo sapiens
tacttccaatttcatcacttgaaatattaaaaagacatattcaaggataaaaatgtagtaaaattttcactgattcatcatagacattctttttatttttgagacagggccttattctgtcacccaggctggagtgcagtagcatgatcacagctcactgtagcctccaccttctgggctcaatcaatcctcctgcctcagccttctaagtagctgggactacaggcatacaaccaccatgtccagctaaattttgtattttttgtaaagatagggtttcaccatgttggccaggctggtctcaaactcctgacctcaggtgatccacctgcctccacctcccaaagtgctgggattaca

SEQ ID NO: 66692 - DNA, 564 bp, Homo sapiens
ctaaaaataagggacaagcttaaaccctgcctctaccgaaaatacaaaacttagccaggcatggttgcatgtgcctgtagtcccagctactcaggaggctgaggcaggaggatagctagagttagggaggcagaggttgcagtgaaccaagatcatgaaactgtactccagcccagacaaaagactgagaccctgtctcaaaaataaatacataaataaaaataagggacatgcaaacataaaatgtggggcagagattactcttggcaggaccaggtggctgaggcctgtaatcgcacactttgggaggccatggtgggaggattccttgaacccaggagttcaagacttgccagggcaacataatgagacttcatctccacataaaaacattaaaaattagcttggaatggtggtaagtgcctatagtcccagctacaggctggggccagaggggtgaggcgggaggaacacttgaactcagtagatcaatgctgcagtgagctctgattgcaccactgcactacagacttagctacagagtgagatcccatctcaaaaaaa

SEQ ID NO: 66693 - DNA, 473 bp, Homo sapiens
caccccttacccttggcactttctggggtcttagaagccctggatagtggtgtaaccctcgggtggggtaacggtaccctttctctgaccctgggctggaggttacttccttggaggccatatcatctcttttaggacccccaaaatacaaattttccatggatttatatcatggggctaggggaacccagagggtcctgctcccactctaggggacagagaaccctaaccctgtgggtccctccctggtctgcccagccttactcttcttcctccacagtttcactggatagtggtttgtttcagggcattcccgggagacttaagcttgccactgcccctcagtcatgtgagagatcccctccttgggcctttgcagggaggcaggggtggagatgtatgggatgctacgtgctcagtcctgggagaccgtggaattccttcagatcacaatatctattggcaatgtcatc

SEQ ID NO: 66694 - DNA, 352 bp, Homo sapiens
tcagcctcccaagtggctgggattgcaggtgcccaccaccatgtccagctaatttttttgtattttgagtagagacggggtttcaccatgttgactaggctggttttaaactcctgacctcaaatgatccacccacctcagcctcccaaagtactaggataataggtgtgagccacagcaccccgccaatatttttgtttctaataaaacaagaactagtagtgcactccgtctagagcaagatagtgtggtggggacagggagcaagtaggtaggggataaataggtcaagaactgaattcacaattgaggctttaagcttgataagaaataaagcaagtttgaatcatct

SEQ ID NO: 66695 - DNA, 417 bp, Homo sapiens
atacccttttgaacaacgagatctgaaatgctaaggataaagcagccatctgctggccatgagaagagaggcaataggaaaaaaaaaactacattctaaagatgaagctgtgttacctgtaatctctagtactgctctgcccccttgtgctgctgcagtgaactcgacagaggaacagtgtgccttcgtctctgtacatgaactacagaaaaaccccactgtcacttctcacttttctgctgtattacaggaaccgttacataaacggagaaagtgaaaatcaatcctagctgacagtgacttcgggataatcagcgctcactggatgcctctgtcagttcgcctgcatcaaacaccgtgtgacttctgtcagatctttttaataaaactatattctcactttcagcaacctaaata

SEQ ID NO: 66696 - DNA, 112 bp, Homo sapiens
aaaacaaaagataatgcatggagaacaaaggagataagtaaggagtatgggggttccacagaagacattgatgtggagtgatgtaagaaatccatgtggaaatgcctagcag

SEQ ID NO: 66697 - DNA, 711 bp, Homo sapiens
acaccaccctgaattcaccagaactttggggagaagctgagaaaccccctaggtccacagaattgaaagaagccagaactggtaagagaaacaatcaattcggactgtgccaccactcccagctggcatagtgtcactcagagaatgtctctagatccatggtttccaaggtgacaggagagaattacaggtgagcattttatctccccactgatctggtcatcttcatgggacacccactctggccccgtcccacaggaaccactgggaatgccaggatagctgaatgacctggggtgaactggggacaaaaagccaagcactgattgcagcaactggtgtactggtgcactctgagctctgatcagtggggacaccatggtgaagggactggctggcacaatccacagggaggtccaaatccctggctgcattttccacgagcctaggtatactcgagagccctcccctggcctggaaacaacaaaaagctcaagattaagttctgatacccacttacatcttccctgaactgggaaatgttgacagagcagcaatatagttccagggcaatgtttaagttccagtgctcaccgcaagtctcactcagaacaggaagaaacaacagaccagagtttaagttccaatactaagtagcaaagctctgacaccaccaagaacccttaaaaaactgtcagaggtgactatctt

SEQ ID NO: 66698 - DNA, 466 bp, Homo sapiens
atgtgtatcaaacagcatgctgtaaaccttaaatatgtacaataaaaataaaacttaaaaataaatagaaaagagagaagaaactgaccacacccccgcccaccccactgactacctgtgatttttccatggttggtaggtggtcaatagattcatcattgatttggtacattttccgaagtatgtgctatggtatagataggtatttggtctcggtctctctccctctctctctctcttttttctttctttctctcaccttgaaaaatagagcggtatttggagaggaggaaaagccaggagaaagttctcaggtcattttgaagaatgccaagttaaaccaagcaagcaagttttgcacccgggacctcttcagagccttgactcttttaagaagcatcatgggccgggcgcggtggctcacgcctataatcccagcactttgggaggctgaggcaggtggatc

SEQ ID NO: 66699 - DNA, 495 bp, Homo sapiens
tctagagatggtagaagggaggtgggattccagggctaagtggttccaggtggtcccagcctaccagctttcagcttttcattagtgtccccttcaaggcaagccccatctctttcagagagcaaacatttacattgatctagggtcgctggaggccattttaccttggaagtatctgggagttgggagctgattaagggcaatacagaacaaatagctcagagatggtctgggaaagaatgaagaaagtaaaattgatatttggggtgaggggtgcagcttttcctgtggaagcagtgtgcagtaatccagggcactatcactgctgtgagtcatcaacttctgggtctctggctcagacaatcttagaaagccagagctggggggtaggggtgcctgttccaaggtcatctagtccaaccctcgcattcgagagatgtggaaactgttgcagagtccatttgtgcccactgaatatccatgtgcttccctgaa

SEQ ID NO: 66700 - DNA, 452 bp, Homo sapiens
caaatattttcagttcattttttatgaacgcattctgactgttccatcccacccacttaaattttcccatggctacatgattttttttttgccgatggaggtgagaagaaataacatgtgactttttcaggagaaatctccaagaaacagcgttctattccgcatgcttttttctcttttctatagcaatggggatcttattgatggtccctccttccttctggattcctgtgttaggatgacacagcacagagctacctctcacctgacccgtgatgagatgtaaataaatgaggaagaagatttttgagccactgaaatttggaggttgtttgtcaccacagtttaagctagcccccactgactgatgcacggctgaagaatgagtccgaactggctctggacaagacatgtgaagagcgctccaggctgagtaaaattcaagggttgcc

SEQ ID NO: 66701 - DNA, 504 bp, Homo sapiens
aactcctgatgtcaagtagtccacccaccttagcctcccaaagtgctgggattacaggcctgagccaccgcgctcagctgaggatcgtgatttttattgggctttccatctctttacaaaatcagtactattaattcagagacactcaccatgagaaaacctgctttcatcgaccttttacaagtgggtagacaataaagcccactggttagtaagtaaacacaaagtgctaattttagctaaaaaaaaaaaatgtgctgcccacactaatctcaagttcagttttttccttcttacatacagctggccaaaaaaaaaaaaaaaaaaaaagcccaggatgacagaaataaattttttcaaacaatatgaaaacagatggagtggctggagatacacaaggaggcagggacatgctgctctctgagccctagtacgtccagccctccttctggccccattcaatgggttacacagggcaccacttggccaggggtttcccaggcc

SEQ ID NO: 66702 - DNA, 389 bp, Homo sapiens
ggcaaactcaccctctttgcaccgctccaagccataagaaacaacccactctctaaaaaaatttttaaatttttatagagacggcacctctctatgttgcccaggctggtcttgaactcctggcctcaagcaatccgcccacctccgcctcccaaagtgctgggattaaaggcacgagctactgcacccagccacaaatgttttaaaaaagtttataataatatgggaaaggagaggactttggtattatattaaactagaaatccacaggacatgggaacagtatccaaaatagtgtgtttttgtacatacacacataactcagaatgtgtcaagaatttttgctcagaaaaaaaaaagtcgacgaaggaaatgcactagaatgttaa

SEQ ID NO: 66703 - DNA, 879 bp, Homo sapiens
tatcgagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagagcttgaagctcaagttcatggcttcatcaaaagacgcttcaaatcctgaagttgagatagctctcacctggagcccgtgtgttgttctaccctttggctgggaacacagtcacctgggaatcattccagcaggtggcttcaaaagtccaacctgctaggttga

SEQ ID NO: 66704 - DNA, 839 bp, Homo sapiens
tatcgagccctggctctccgggcagctggaggggtcgcgctgcgcctgttggggctgcacctcggaccagggcttctgctgcatctgcagccatgtcgggccgctcagtgccacatgcccacccggccaccgccgagtacgaatttgccaacccgagccgcctgggtgagcagcgcttcggagaaggcctcctgccagaagagatcctgacccccacactctaccatggctactatgtccggcctcgggccgccccagctggggagggcagcagggcaggggcctccgagcttaggctcagtgagggcaagttccaggcatttctggatgtgagccactttaccccagacgaggtgactgtgaggactgtggataacctgctggaggtgtctgcccggcacccccagcgcctggaccgccacggcttcgtgtcccgagagttctgccgcacctatgtcctgcctgctgatgtcgacccctggcgagtccgagctgctctctcccatgatggcatcttaaacctggaagcacctcggggtggccgacatttggacacagaggtcaatgaggtctacatctccctgctccctgcgcctcctgatccagaggaagaggaggaggcagccatagttgagccctgattgccacagacccagcacccagcaaatccctctctacctcccaaggtgatatgggcagctgcccaccactccagaggtagcagcatccttgggggaagggaaaggtgcatggtccacaatgtatggtttggtcccatgggacatgtcatagccttggtttagttttgggtggagctgaataaacccaaatctcagggc

SEQ ID NO: 66705 - DNA, 457 bp, Homo sapiens
actttaggcaaaccaaagtggaaggtaaacgttacccttattttatagcttccctgtctaattctcaaagtttttatgtatataaagttgcctactatgcaaataatttgaatatgttaatgttgcctaagtgatacatctcttcatctgtatgcatgtgattaatataacctgaccaccttacgcagggggctgaaaccattgcaacaatgattaatcatttctgaataatatatgccccactagaaatcgtttcctcccacgattaatcatttcagatatgaagttttcaggtggggcaacacattttgccccagtttccattcatattctgcattatagatcaagcaaatagaaaatcagcataaaagtttacattgatccagcagccttagtttaaattgtttaatatctagaactaactgtaaaactcttaatgcagtcacttaaaaaaaaa

SEQ ID NO: 66706 - DNA, 3917 bp, Homo sapiens
cccacgcgtccggatggtcctggtcacaaaatattaaagagaccgaccgctaagggaacaggaaaaacgtccgagacagccgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatgatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaagaatgattgtcaaaccttataaactttctgaagggtataatgcttaatttttagccatttacttttaaaatctaaaacgccattttctacctacgtttagcacaaaattggcacttcaaatttatttctcaagaatatcctaagatcccccagggtctcaacattcattctaataaagaatttattccaagaatgggtaaggaaattaggaagccaagactacttcatttgattattcaaatatgaatagagaatatt

SEQ ID NO: 66707 - DNA, 3172 bp, Homo sapiens
agttcgacggagactctctgcagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaagaatgattgtcaaaccttataaactttctgaagggtataatgcttaatttttagccatttacttttaaaatctaaaacgccattttctacctacgtttagcacaaaattggcacttcaaatttatttctcaagaatatcctaagatcccccagggtctcaacattcattctaataaagaatttattccaagaatgggtaaggaaattaggaagccaagactacttcatttgattattcaaatatgaatagagaatatt

SEQ ID NO: 66708 - DNA, 3282 bp, Homo sapiens
gagaatttaggggaagtcagactaatccctgggtgcacttcgagagaaaggttggacctcgcctgagggatgctggatctgcaatgatagaattggcctgccacagacattggtatttaagttgaagagcagaattcacaatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaagaatgattgtcaaaccttataaactttctgaagggtataatgcttaatttttagccatttacttttaaaatctaaaacgccattttctacctacgtttagcacaaaattggcacttcaaatttatttctcaagaatatcctaagatcccccagggtctcaacattcattctaataaagaatttattccaagaatgggtaaggaaattaggaagccaagactacttcatttgattattcaaatatgaatagagaatatt

SEQ ID NO: 66709 - DNA, 4170 bp, Homo sapiens
cccacgcgtccggatggtcctggtcacaaaatattaaagagaccgaccgctaagggaacaggaaaaacgtccgagacagccgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaagaatgattgtcaaaccttataaactttctgaagggtataatgcttaatttttagccatttacttttaaaatctaaaacgccattttctacctacgtttagcacaaaattggcacttcaaatttatttctcaagaatatcctaagatcccccagggtctcaacattcattctaataaagaatttattccaagaatgggtaaggaaattaggaagccaagactacttcatttgattattcaaatatgaatagagaatatt

SEQ ID NO: 66710 - DNA, 4223 bp, Homo sapiens
cccacgcgtccggatggtcctggtcacaaaatattaaagagaccgaccgctaagggaacaggaaaaacgtccgagacagccgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaatatgtttgtcaggctgtttgtagatgaaaacttggaccgaatggtcccaatctctaagcagcccaaagaaaagatccaggctatcattgactcatgcaggcgacaattccctgagtatcaagagcgtgccagaaaacgtatacgtacttacctcaagtcctgcaggcggatgaaaagaagtggttttgagatgtctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaagaatgattgtcaaaccttataaactttctgaagggtataatgcttaatttttagccatttacttttaaaatctaaaacgccattttctacctacgtttagcacaaaattggcacttcaaatttatttctcaagaatatcctaagatcccccagggtctcaacattcattctaataaagaatttattccaagaatgggtaaggaaattaggaagccaagactacttcatttgattattcaaatatgaatagagaatatt

SEQ ID NO: 66711 - DNA, 4031 bp, Homo sapiens
cccacgcgtccggatggtcctggtcacaaaatattaaagagaccgaccgctaagggaacaggaaaaacgtccgagacagccgttgcaattacgaatggaccagacttggtagcacggggcattgattgctggtgcccaaccggaccctcctcccctcttcccatcccttcccccacccaaagcaggctcccgctgcggccgggacctcgcatccctgcaacgtggccggggctgcatttttcatgagcctagggtgaacaggtgcgaagtgcgctgggagcatccggccagcggccgagcgcggggaacatggagagcgagcgcgacatgtaccgccagttccaggactggtgcctcaggacttacggggactcaggcaagaccaagacggtgacccgtaaaaaatacgaacggatcgtccagctcctcaatggctccgagtcgagctccacggacaacgccaaatttaaattctgggtcaaatcgaagggcttccagctgggccagccggacgaggtccgcgggggaggcggcggcgccaagcaagtgctctacgtgcctgtcaagaccacggatggcgtaggggtagatgagaagctatctttacgacgggtagctgtggttgaagatttctttgacattatttattcgatgcatgtggaaacggggccaaatggagaacaaattcggaaacacgctggacaaaagagaacttacaaagcaatttcagagagctatgccttcctaccaagagaagcggtgacacgatttctaatgagctgctcagagtgccagaaaagaatgcatttaaacccagatggaacagatcataaagataatggaaaacctcccactttggtgaccagcatgattgactacaacatgccaattaccatggcctacatgaaacacatgaagctgcagctgctaaactcacagcaagatgaggatgaaagttcaatagaaagtgatgaatttgacatgagtgattcaacacggatgtcagctgtgaactctgatcttagctccaatcttgaagaaagaatgcaaagtccccagaatcttcatggccagcaagatgatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaagaatgattgtcaaaccttataaactttctgaagggtataatgcttaatttttagccatttacttttaaaatctaaaacgccattttctacctacgtttagcacaaaattggcacttcaaatttatttctcaagaatatcctaagatcccccagggtctcaacattcattctaataaagaatttattccaagaatgggtaaggaaattaggaagccaagactacttcatttgattattcaaatatgaatagagaatatt

SEQ ID NO: 66712 - DNA, 3150 bp, Homo sapiens
ctcttattttccaaagctccaggtgctgttttccttgggactcatatacagagtctttggttcaaatgctatggtacccaggctgaaaccttgagagaagaaccaccgccttggcccagtgaacctgaaggccatacccacagacctaaatactgcaccttctgtgtagcagctactcaggatggaccaaactatgttggatgattctgctgcagagagctttaatggcaatgagactctggggcacagttcaattgcttcagggggaacacacagcagggagatgggagactccaacagtgatggcaaaactgggctggagcaagatgaacagccactgaacctgagtgacagtcccctctctgcgcagctaacttcggaatacagaatagatgatcacaacagtaatgggaaaaacaagtataagaatcttctaatttctgacctcaagatggaacgagaggcgagagaaaatggaagcaagtctcctgcacatagttactccagctatgactctggcaaaaatgagagtgtagaccgaggagctgaggacctctcactaaacaggggagatgaggacgaagatgaccacgaggaccatgacgattcggagaaagttaatgagacagacggcgttgaagccgagcggctgaaagcttttaattctcgacctattccttcccaccttacttcagcagttgcagagagtatcttggcttcagcttgtgagagtgagagtagaaatgccgccaagaggatgcgtctggagagacagcaggatgagtctgctccagctgacaaacagtgtaaaccagaggcgacccaggccacttactcaacatcagctgttccaggctcacaggacgtgctgtacatcaatggaaatgggacctatagttaccatagttacagagggctaggagggggtctgctaaatctgaatgatgcttccagcagtggacccactgatctcagcatgaagagacaattggcgactagctcaggatcctccagcagctcaaactccagaccccagctgagtccaactgaaatcaatgccgtgagacagcttgttgcaggatatcgagaatcagctgcatttttattgcgatctgcagatgaactggaaaatctcattttacaacagaactgagacagacgaccaccatattcactgaggtctaaatttgcagtttccactaatgacattttgatttcccaacagagatacttctggtcttactgcacagtcttttaagagaaatacttccattatgccacattgtccttgatccgtaagtgatgtgttaaggtgcttcaaaggaactctgacctctgaagtacttgagctactttagtatgtccagcctattgctttttgttttagtgtgtcaccataaatatcaggggcataaaaggctatctattcttaattcaaggataaaacagaagaagcttgtggtataaaacaatagttcaagatccagctgaaatattagtggaatttgctactgactcattggactgaaagctgaagtacctggcaaaaaaaaaaaaaagaaaaaaaaaagccaaatttcttgttgctacaggatataacaacaatgaaaaggatctcgtattttaaaaaaatatgtaatttttataaaaagaaaacttgtttttcattcaaacttgtcatttttactttggtaactttttcataggtcctaaaagaaaactgttttgagaaactactgtaagtaccttttccacatccctttgccttctcctctttccaaattctttctacaaaaataacacttgatgctggaaaaacccttgcctacgttctttcaatcgtcacatcaggaactacttccaagagaagcctgcatttctgctctcatgctgatctcaaaaaccccactcaacactgcaactttatcatagcagttttcatcccagaattttttttttaataatgacaagacatgttgttgaaaaaaaatcacaccttggtttcttagagctgctcgttcctgattgccgctgctgtctccaggcatccctctagcagcacctggatgtagatgactgaatgttaagaggttgcaagtgacaatctgaaaatttgcactcttgtgtgtagttttcttttcatttctttcagaaatagtttccaaaaagaccattacatctcctgatatgatttgtataattttcagttctagctaaaaataatgtaaggaactctcagcggatgcagctgcaacttacaatgaactgtgccctcctatcccccatactttacccttctttcttattttatagtgtgggatacacatgagtgatgttttctttgtgcactgagacaagcctattttttaaatatttagggagaagtactttagttcatgcttcttatacaacttttttctgttgtttagctttggttggattacaaattctttgtgcattcctgaatttgccttatttcatgtaaaatttatgtcattcagtttttgacaatgagtttgaggcatcagtgatatttcttatctacttgttacatatagtttttcaagtaatgactgtgattgtgaccgagtaatgtgcactttttcttgtaactgtggacattgctatgcttttttcttctagtgtttctagaattactgttccttacaattatgtaaacaaaaaacaaaaaaaaaacttttgtgatactgttggtgaatataatgtgaaaaatcttattgaaatatgagtattttggaaatacatagctgcacaaacatcttttaagatgtggatttagagtttgcttatttaaatgaaaattcaaaaattgagggctggtataattttctctgttttgtttggtttaataaacagatttctgtgttaaaagaatgattgtcaaaccttataaactttctgaagggtataatgcttaatttttagccatttacttttaaaatctaaaacgccattttctacctacgtttagcacaaaattggcacttcaaatttatttctcaagaatatcctaagatcccccagggtctcaacattcattctaataaagaatttattccaagaatgggtaaggaaattaggaagccaagactacttcatttgattattcaaatatgaatagagaatatt

SEQ ID NO: 66713 - DNA, 854 bp, Homo sapiens
cttttttgaatagaaggtgtctttgtttgtttgattttattttttcttcaacttcgctgttctacaatgacaagagatagaacagagacattttctacctcaacattgggaggcagaaaattcacctttttatccaagaataccaaaccagaagctgaaatatctggatctgatagagaggatagtctattcccccttggactttggactggatgcaataatggtatgagaccctggggtaggaatgagtgtcttctatgtgtgggaaagagaggaaagcagatatttggcgacctaaaaagaaggccatggcagaacctcattagttgttcaacaatcctattttccttttctcctggacacacagctatgcattttccagccatccttgtggttagatgcccagtgacagttctgagaatggaatatggacagatgtgataggcacttctgggcctgggccacaaaaaccttccacatgatgtccagtgcctcttttaccccactgacagttttttattgtcatccagagagaccttggatggtttagaagccatgtgtagaagatggcaaccttcccttagcatggatccttgaatgactgtggagtgcaatgccttctaccaattacacctactgtgtttgagaatcaaatttcatttgtattaagctactgatttggggggtttatctccttcagcacccacattagtacaactcatgcagaatggagagttaatgtgaacacatatggcacagactggtgaaacctaggactttaagatgatagatgaatttctgattatactttcctttcccgcaaaaagtttttttcaaattaaatgttgtaatat

SEQ ID NO: 66714 - DNA, 407 bp, Homo sapiens
tagggagagggaggagacagctcacaggttgcttttaaaactttgcagttttaaaatagttgggaatattttaaaacgcagatcaatttctcatgaaactcaaagtttttgatttctttcaaaacattagtcaacactggacctacatttacacatggcaacaattggctcagggccagcagctgctgtctttaatcgaggcaaatttgcttgagttaactgcactccccactactccccattgcctcccaacactgagactaagtggcagccgtcttttatcatcttacacccaactcacttactaactttcatttcctgcccagtctgggtagacattggctttgcaaccccaaatctaagccaatagtctaaggcttctgggatccaaattctttggggccttt

SEQ ID NO: 66715 - DNA, 536 bp, Homo sapiens
accaaaaatacaaaaattagccaggcatggtggcacctgcctgtaatcgcagctactcaggtggctgaggtaggagactagcttaaacctgggaggtggggcttgcagtaatctgagattgtgccactgcactccagcctgggcaacatggcaagaccctgtctcaaaaaaaatttttttttaaattaaaaacaaaatgtcaagcatagctaggcacagtggcacacgcctgtaatcccagcactttgggaggcagaggcaggaggatcatttaagcccacaagttcaagaccagcctgggcaacacagtgagagcttcttgtctctacaaaaattttaaaaattagtgaggcgtgatgtcatgcacctgtagtctcacctactcaggaggctaaggtgggaggatcgcttgagccacagaggttgaggctgcagtgggttgtgattgtgccactgcactctggcctgggtgacagagagagaccctgtgtcaaaaaataaaataaatgaaataccaagcataatgcttgttatgt

SEQ ID NO: 66716 - DNA, 476 bp, Homo sapiens
aatcttcagtttccacatctgtaaaagtagtatgataagcataattatttcttaggtttgttgtgtgaaacaattcagacaaaatttgtgttccatcagtgttagctatttcataattgggttgctttgggttgcaagtaacaaaaaaaaactcgaactgacttaaattataaagggaatctattggatcctataaccagaaaatccagaggctaactcaatagctcaaccaaaagtcacaagaatctagtgtacttctgtctctccacccagcctccactattattagccttctaaattaccccattcttaaacccaagatggctgccaactcccacagctacctacctacatgttttctcattctcacccaggaggaaagattgagcccttgtgttccagcattctcaaccaagtcccaagatttaccctgattgaaagagcttaggtcacatacccaaccctgaatcagtcac

SEQ ID NO: 66717 - DNA, 160 bp, Homo sapiens
caaatttgaaaagaagaacatagagaagcctgaaatcagcaaaggaaataaaaacaaggacatcagaagcgtttgaaacatcctggcaacacagatacagcaaacattaaacacagcacaatgcctagccagattaaaataaaacctcaaattcaaggcc

SEQ ID NO: 66718 - DNA, 951 bp, Homo sapiens
ctttgttgcagggggaaataaagagaggcgccaagcctgcaaattctttcctgatcccattggttcaccaggagagaacaattttgttttccatggttgcggtctttcaaggttgcctttacttaggatttgattacctgtctccctcaaccaattagcctctcccacacactctcttgcctccaataatgatcaacctccttttctaagaccagcctcctctttatcatattgcattaaacacttgatgaaagaagacctagaaggctttaagaaagacagggtaatattttgctggtgtagagggcctgctcttcggagacaaatacttgcttttcattttgatcagccgtctgcacttaaaagcctcctagccagggacatgttaattaaacagtctggggctcagtgctgccatccgtaaattggaggattagagaaataatatacacaagtacctggtacataccaaatatgatagaagatatcttcaacctttagctataagaagaatggaaaatgaaaaagagacaggtggagagagggagggagatgagagctgcgtggagctggtatgctggttaggaggtaggaaataatgaggcctcgaccatctaagatacagaagtctccctgctgaatcgaaaggaagtgctacaatattctttcaaattcatcgcagttgagagaaaactggagcagagtgtgatatcaagaaagggcttcaccaggatgatcaatgcaaatggatatggagctttcttggaatgaaacattatcccgtaacaccaggtatacatacatgaagaagtggccttcaggactggaactgggaagataacagacctccacagagaaactggacgggaaattgctatatgcctctgcgtggtgatcattacgttgtaatagctcaactcatcactatgtacagacatccatattaaccca

SEQ ID NO: 66719 - DNA, 557 bp, Homo sapiens
acctctgatggaaaaatctggttgtctccctgcaggttgctaagaaagagtgatgtttcagggaggctgagtcttgaagcagcagcagcagatctgacacttgtccttcacagctcctttcctgtctcccatagtaagggctatgtaaacatttcatgatcagtgctggcacttgcagccgagaatgcggagaatgcttgcagtttccccttttcatgcagcagaatgataacagggacaatcttttgattgtcttattatgttttggcttttgttgcttttaaaattcccagtttgtgttgctgtaagggaggtaacatttctcaccctttctgtaaatgagtttcctgccaaaacctacctgtgagtttcaaatgtttagaccaatcaaccaaccaaagaccttgagataacctaagaaggtataacctaagaagggacagttacacagtaattgggaaaacttctgcaaggacagatgtgcatttctcattttctttaaacctatcaatttactgaaaatgaatatgatttttgttaataatgacagtgccaaa

SEQ ID NO: 66720 - DNA, 354 bp, Homo sapiens
ttttttctgagcaaatgctggtatagagaaaatggctgtagtgcatgcactggaaatgggagacaagagtccttgtgctgtgccttggaggtcattagagtggtcccattagagtgaaaaatagtccaagtgtgtccatttatttaaaatctattacataataccagttataacaatttgatggaaaaaataagcatgaaaattcgaagaggaggtaaggaggtaaaactaaagttcttttcagatgtgatgattttatgtctagaaaacccaaaataataaacgaaaaagctaataatgtaaattataaaagacaatttacaatttataaagtaactgggtttaacattagtg

SEQ ID NO: 66721 - DNA, 1318 bp, Homo sapiens
ccattgcactccagcctgggcaacaagagcaaaattctgcctcaaaaaaaaaaatagtaataatacaaaaattagctgggcgtggtggcacatgccagtaattccatctactcgggaggctgaggcaggagaatcgtctaagcccgggaggtggaggttgcagtgagcccagatggcgctgctgcactcaagcttggatgacagagcaagactccgtttcaaaaaaaaaaacctcctctcttccttcacaccttcctctgaatcccacccggtcccacctcctgaacctatccagacaccttctcctgacccaggcaccacctgctttcggggcgatggccgtagcctcctcccaggcacctgtctgcatccctctggccagtgcatgctgagcacgtgacctacccgtgttgggacacgtgaggatacagccttgacccccaggggctgacattctagggggagatagaaggagacaaacgtagaaggtagaataagtgggtggtggagtggcagggagtgctgagtgccacaggaagtcagacaaggaaggagagtgtggggcaggtgccgtttaaatggggggcgctggggtctcctcacagttgcttctcagctcagctgtgccaggatcttgttgagtcaggtcagctgcccacagccctcttgcctgacccctgaagcccagaactctgatcttcacagccctaggtatggccccagcaccccactgccctctctcctgccccagccgactgctgttcccagacttccctggccacgctccaagacgccagctctgccgcgggcactttgttctcacggtgtcctccatgcctgcagggcccatgcatgggaagttgcgttggcggcctgggtgttggcggttccgtgcctgctccaactctccgtgaggcccctctcccagagcctgacacactctgtggccgaactctaggcaggtgcccctgagtcctttcctcgacgaggcctgaccccatccccatcctcgctgggcccgccgaccccggtgttagcaagaatcctctaaatcagtttatggagaattacccaccctcgatatctgatcccattcctcatctcccacccttgatctcatcaccctgccggcctcctgcaagatcctcattgagccactccagtgagaatccccctaccctcgaaggccgccctaacaacttcccatccgctgacccctccaacgccatcaatctccagctgtggttgttgaactcggaggtgagctcctctcaccactctcttgaataaagcttttctcaccattttaaaaaatcct

SEQ ID NO: 66722 - DNA, 652 bp, Homo sapiens
ccattgcactccagcctgggcaacaagagcaaaattctgcctcaaaaaaaaaaatagtaataatacaaaaattagctgggcgtggtggcacatgccagtaattccatctactcgggaggctgaggcaggagaatcgtctaagcccgggaggtggaggttgcagtgagcccagatggcgctgctgcactcaagcttggatgacagagcaagactccgtttcaaaaaaaaaaacctcctctcttccttcacaccttcctctgaatcccacccggtcccacctcctgaacctatccagacaccttctcctgacccaggcaccacctgctttcggggcgatggccgtagcctcctcccaggcacctgtctgcatccctctggccagtgcatgctgagcacgtgacctacccgtgttgggacacgtgaggatacagccttgacccccaggggctgacattctagggggagatagaaggagacaaacgtagaaggtagaataagtgggtggtggagtggcaggaaccgcttttggctaccggaagcccaagattcttgggagagaagaatttgtaacaatcaccttctcgagaattgttatagtttaaaaattgttatcctcttttttgtgggaacacaccctgtggtgtcccccaag

SEQ ID NO: 66723 - DNA, 809 bp, Homo sapiens
cttaatagcttcaagtagctagcaaaatctttttctcaattacttgttatatggctttttgcttccactagcaacagaaatttccattagaaattttacctatccatgtgttctggccatctggaccagcacaagtgggatgagcaaactaggccaggtgctgaagttgctacctgttcatttggcagttcctctcagagtagtctttactcttccaattccatatgatcatatcctttggaagtggcaaaggctaaagtaattggaaggaagccatcaaggaaaactcatacatgagaacacatgtgtaaagtagttctcttacaatcatttggaaattggcagctttgttcatttctccctctttagtattcctgtatattctacttttgtgaatatttggttgtttttagtaatgtttcatttctgattactattttcttgtgttttgatgtaattttgtctagaaaaccactctataatacctataaggtaatcctaaagaaatattctttaagtgtttcttgtaattgccacttttttcctgtcaagtactttcagagaaactggatgaatctatatctgcttacgttttgctggcattgtatgaaggatacctgtacatatgatttagttaggtttgacaatttcatgaaaatagtgggttaaatgtattctctgttaattcacactattttaaatttatagcattcttttaaaagattctatacttaatataaaaataattataggattgggtttttcttctgctgaggtcttgatttgcaacatgtttttcaaattgttaa

SEQ ID NO: 66724 - DNA, 582 bp, Homo sapiens
cacgaggtttttttttaaatacccactctcagggatgcagctgtgatggagaggttgggtatttaaattaaaaagtagaaagacagcaggcaccaagaagagagagcccccaccccacacgagagggaaggcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctgaaaaaaaaaaaaaaaacaaaaaaaaaaaaaaaaaaaaaaaaaaaaag

SEQ ID NO: 66725 - DNA, 6490 bp, Homo sapiens
  misc_feature (1671)..(1671): n is a, c, g, or t
atcagagcggagtctccttgctctgggctgctccaggccaggccatgcggaaagtgtgttgttatgaggattcaatgaggagacctgtatgaagtgccttcccctgtgcctggctcatagcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66726 - DNA, 535 bp, Homo sapiens
cacgaggtttttttttaaatacccactctcagggatgcagctgtgatggagaggttgggtatttaaattaaaaagtagaaagacagcaggcaccaagaagagagagcccccaccccacacgagagggaaggcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66727 - DNA, 292 bp, Homo sapiens
caacggtgctgggctagaccaagctctgcctgaaccttagtttcagccctggagcccttgagagagctctgctgttggttagtaattaccgtgaaagtattcagcttcttcattacaaggacagaaagtgtgttgttatgaggattcaatgaggagacctgtatgaagtgccttcccctgtgcctggctcataggcacaggttaccttcagcgccatggccttttcatcaaggttcgccttctgggagcaaaaggaaagttggattttaaaatctttatgtttttcctgtgt

SEQ ID NO: 66728 - DNA, 6495 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66729 - DNA, 6512 bp, Homo sapiens
  misc_feature (1693)..(1693): n is a, c, g, or t
ccagccaagcctgaagccccaaagaagcagcgctccccagccccaccggaagagctggtgaccccaggctccaccggcccgaagtcagacctcactggagagcagcagtccaagtcaccagtccctggtgtgaagcaggaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66730 - DNA, 5354 bp, Homo sapiens
  misc_feature (535)..(535): n is a, c, g, or t
agaggccccgaggagcaagcggaagctgctgaaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66731 - DNA, 5570 bp, Homo sapiens
  misc_feature (751)..(751): n is a, c, g, or t
ttgcaggctctctaccttccaggttctacgacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66732 - DNA, 5988 bp, Homo sapiens
  misc_feature (1169)..(1169): n is a, c, g, or t
cgtccttatcgtggcttagctcctcaaggaggctccgcgggctgacccaccctgctcagcggttctggaagcccggggtgtcgacaatcatcatggagcagagtgagtgctggctggacttgagagccctattcaccaggcagacgagaagggtgaagagctcgctgtagaggccggccgccatgccctcaaggcactcctagtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66733 - DNA, 6802 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggc[433 bp omitted]ttctccacctatgcttctgggtctctctgtatatgcaccccatcttggcccctagctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66734 - DNA, 3584 bp, Homo sapiens
aagggaattcgtgctggtgctaagggaattcctgctggtgctagggttcgtgctggtgctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66735 - DNA, 6540 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66736 - DNA, 6587 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctgaaaaaaaaaaaaaaaacaaaaaaaaaaaaaaaaaaaaaaaaaaaaag

SEQ ID NO: 66737 - DNA, 6633 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctgaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaag

SEQ ID NO: 66738 - DNA, 1799 bp, Homo sapiens
gtgactctagagatcctgctagttatcggcacgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66739 - DNA, 6462 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66740 - DNA, 1708 bp, Homo sapiens
cagctccagctccagctccggctccgaagcttcctcagagcacaagaggcggaagaaggggcgctctcggaagagcaagaagtccaagtcgagaagaaagagaacggagacggagtctgagtcctcctcgtcgtcatccagcggctcgaccgtctccagccacagctgctccagtgtgaagaagggcccagctgcagaaagtgaagaaactgggcagacgcaccggccgtcgaggaaggaggaaaagaagcgcaagaaagaggtggacagcctgatgatgcggtacctgtaccggcccgagagcgactagtgcaccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66741 - DNA, 6340 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctgaaaaaaaaaaaaaaaaaaaaaagaagaaaacaaagaaaaaaaaaaaaaaaacaaaaaaaaaaaaaaaaaaaaaaaaaaaaag

SEQ ID NO: 66742 - DNA, 4673 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggaggtgggttcacacttctcccgg

SEQ ID NO: 66743 - DNA, 4500 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccaggtatccacagagagcacacggctgatccaggcacaacagagcttacctttccattctctttctctctctcgctcctctcagtggttcttgagtccttgggaaggaaagtgacaggaaagaggggagagccacgtgtagcagctagactccccaggctctgcgtgtgccttactgtctcaccgcccagcctgggatggtgtggatggggcctggtgcccaccagccatgtcacgggaggagatccccacgcgtgcaccaccacacagccatggccctggggtctgaagtgaatggaggagga

SEQ ID NO: 66744 - DNA, 4296 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgccgtcggagacggcgatggagcggatgccaccgaccatctaaggagactggcgagcgggatgacgaaggggccgaaggccggcagcgcgtccgaaaacgctccacccgaggcgcgccccacagcccagcatacggcacccaaacggcccgcccgcacacgcaccttcggcaacccccaccccagacccagggaccaccggcctgagcacaaaagcgccccacgccgtactccccgccccggaaatgccgccctggcgcccgactaacgcccaccacgacagaagcgcccccacccagcgcgcccacacacacctcgcacccccgacacagcggccaacccccgcagacaaaccaaccaaccacacgccaccacaccccgccggccaccacacagcacctcggcacaagcccaccgccgaacacacaacgccccgcccgccgggagcaacag

SEQ ID NO: 66745 - DNA, 356 bp, Homo sapiens
tcgaattcaagcttctaacgatgtacggggacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctgaaaaaaaaaaaaaaaacaaaaaaaaaaaaaaaaaaaaaaaaaaaaag

SEQ ID NO: 66746 - DNA, 291 bp, Homo sapiens
cggctcatgtgtggctcttcgcggggctcatggggtggcgcattgtgtggctcctggtggagttctcaggcataacctttttagggtgggggctggaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctgaaaaaaaaaaaaaaaacaaaaaaaaaaaaaaaaaaaaaaaaaaaaag

SEQ ID NO: 66747 - DNA, 378 bp, Homo sapiens
cagctccagctccagctccggctccgaagcttcctcagagcacaagaggcggaagaaggggcgctctcggaagagcaagaagtccaagtcgagaagaaagagaacggagacggagtctgagtcctcctcgtcgtcatccagcggctcgaccgtctccagccacagctgctccagtgtgaagaagggcccagctgcagaaagtgaagaaactgggcagacgcaccggccgtcgaggaaggaggaaaagaagcgcaagaaagaggtggacagcctgatgatgcggtacctgtaccggcccgagagcgactagtgcagtaggtggcacctggcctgggttcagcatggtgtgtcccacccggtgtgaactaacgtcctccc

SEQ ID NO: 66748 - DNA, 6457 bp, Homo sapiens
  misc_feature (1638)..(1638): n is a, c, g, or t
atcagagcggagtctccttgctctgggctgctccaggccaggccatgcggctggactctgaggccgcctctcatgcccacagccaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66749 - DNA, 6269 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacggatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66750 - DNA, 5032 bp, Homo sapiens
  misc_feature (213)..(213): n is a, c, g, or t
aaaatacagtgtgtttccttgggagctgtttcatttgggatgatggagggagctcctgcacggcacagaaggaggttggccttgctgatctcagagccccttcccagcctactcacaaggctgttccccacaatgtgacccccatgctcactaccgctcggccttctttcccaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66751 - DNA, 3062 bp, Homo sapiens
tgggtttgctcgaatctaagaaggatcccctatcatgtatggtacgaaaccacgaactggtagaagaagcagagagaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66752 - DNA, 2267 bp, Homo sapiens
gatcatggtagagcattgcaggttccaagatcgaaaaccgtggacctgtagaattgatgactatctgcctcaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66753 - DNA, 6622 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctgaaaaaaaaaaaaaaaaaaaaaagaagaaaacaaagaaaaaaaaaaaaaaaacaaaaaaaaaaaaaaaaaaaaaaaaaaaaag

SEQ ID NO: 66754 - DNA, 1575 bp, Homo sapiens
agtctccttcctcttagcattttgagtatcttctaagtaagccaaggaaggtttttacttaacaatgtttggcttttggggagtgctctgacgcagctttgtgggcctccagaaccaaaggcgtgcgtgcttaatggtaggagtgtcatttgtccctaaccttattcctcggtccctgcagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66755 - DNA, 1430 bp, Homo sapiens
attaggcgcgttctgcgtgagaagaatgagatccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctaccctgtgtcaccgtgggcagtggcaggtggcctggcactgcatggagccagcacgttgacctccctctcagctccctgctcagggacggtggacaggttgcctactgggacactctaggttgctgggtccatggggaggattgggggaggagaagcagtgccttccctctcgtgtggggtgggggctctctcttcttggtgcctgctgtctttctactttttaatttaaatacccaacctctccatcacagctgcatccctgagagtgggagggggctgtagtggtagctggggctcccaagaacgactcgggaatgtcatctccatcttcacccttcagagagcagtcctttctctgtgcagctggagacgctggtgaggagagccgggtccaggttcttaagaatgaggtgcggaggggctctccggtgctgctgggctgggttgagcaagcctacgcagacaagtgtgtgtgtggaccatccgcacctccagcccccaccccaccctctttgtctcagcgtgttatgtgcaatgacctatttaaggtaaacccattccaactacagcagttcagggctgatccaagcactgcctccctcctgctctgtccaggtggtctggaccataaactcaacttgagagggaaggcttggggttgaggacttgtgatcagaaaaactgaagatggaagttttggccggtgctcattagacatgagtcctcactctgtgtcctgagcccgtgtcattcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctg

SEQ ID NO: 66756 - DNA, 5656 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaaacagatggaggtgcagctagaggaagagtatgaggacaagcagaaggttctgcgagagaagcgggagctggagggcaagctcgccaccctcagcgaccaggtgaaccggcgggactttgagtcagagaagcggctgcggaaggacctgaagcgcaccaaggccctgctggcagatgcccagctcatgctggaccacctgaagaacagtgctcccagcaagcgagagattgcccagctcaagaaccagctggaggagtcagagttcacctgtgcggcagccgtgaaagcacggaaagcaatggaggtggagatcgaagacctgcacctgcagattgatgacatcgccaaagccaagacagcgctggaggagcagctgagccgccttcagcgtgagaagaatgagatccagaaccggctggaggaagatcaggaagacatgaacgaattgatgaagaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtttgcaggacatggtgacaaagtatcagaaaagaaagaataaacttgagggagactctgatgtggactcggagctggaggaccgtgttgacggggtcaagtcctggttgtcaaaaaacaagggaccttccaaggcagcttctgatgatggcagcttaaagagttccagccccaccagctactggaagtcccttgcccctgatcggtcagatgatgagcacgaccctctcgacaacacctccagaccgcgatactcccacagttatctgagtgacagcgacacagaggccaagctgacggagactaacgcatagcccaggggagtggttggcagccctctcaccccagggcctgtggctgcctgggcacctctcccaggaagtggtggggcaccggtctcccccacccgactgctgatctgcatgggaaacaccctgaccttcttctgtcaggggcactttccaggctatgggtgtctgatgtctccacgtggaagaggtgggggaaagaggagtttctgaagagaactttttgctcctctgtctcaaaatgccagactcttggcttctacctgctcccatctgccgccccccttctctcctgcaattggtttgtactcactgggctgtgctctcccctgtttacccgatgtatggaaataaaggcccttttcctcctg

SEQ ID NO: 66757 - DNA, 4083 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcagatggaggttatggaaatggaggtgatggaggcccgtctcatccgggcagcggagatcaacggggaagtggatgatgatgatgcaggtggcgagtggcggctgaagtatgagcgggctgtgcgggaggtggacttcaccaagaaacggctccagcaggagtttgaggacaagctggaggtggagcagcagaacaagaggcagctggaacggcggctcggggacctgcaggcagatagtgaggagagtcagcgggctctgcagcagctcaagaagaagtgccagcgactgacggctgagctgcaagacaccaagctgcacctggagggccagcaggtccgcaaccacgaactggagaagaagcagaggaggtttgacagtgagctctcgcaggcgcatgaggaggcccagcgggagaagctgcagcgggagaagctgcagcgggagaaggacatgctcctcgctgaggctttcagcctgaagcagcaactagaggaaaaagacatggacattgcagggttcacccagaaggttgtgtctctagaggcagagctccaggacatttcttcccaagagtccaaggatgaggcttctctggccaaggtcaagaaacagctccgggacctggaggccaaagtcaaggatcaggaagaagagctggatgagcaggcagggaccatccagatgctggaacaggccaagctgcgtctggagatggagatggagcggatgagacagacccattctaaggagatggagagtcgggatgaggaggtggaggaggcccggcagtcgtgtcagaagaagttaaagacatgatggaggtgtcagctatgaggaagaggaggcgaaaaaaaaaataaaaataataaagaaaataataataataaaataaaaaagagaagcaatacattaaagtaataaaaatggtaacaattactat

SEQ ID NO: 66758 - DNA, 3261 bp, Homo sapiens
  misc_feature (1676)..(1676): n is a, c, g, or t
caacggtgctgggctagaccaagctctgcctgaaccttagtttcagccctggagcccttgagagagctctgctgttggttagtaattaccgtgaaagtattcagcttcttcattacaaggacaggcgaaaacagaagaacagattgcagcagaagaggcctggaatgagacggagaaggtgtggctggtccatagggacggcttctcactggccagtcaactcaaatctgaggagctcaacttgcctgaggggaaggtgcgtgtgaagctggaccacgatggggccatcctggatgtggatgaggatgacgttgagaaggctaatgctccctcctgcgaccgtctggaggatctggcctcactggtgtacctcaatgagtccagcgtcctgcacaccttgcgccagcgctatggcgctagcctgctgcacacgtatgctggccccagcctgctggttcttggcccccgtggggcccctgctgtgtactctgagaaggtgatgcacatgttcaagggttgtcggcgggaggacatggcaccccacatctatgcagtggcccagaccgcatacagggcgatgctgatgagccgtcaggatcagtcaatcatcctcctgggcagtagtggcagtggcaagaccaccagctgccagcatctggtgcagtacctggccaccatcgcgggcatcagcgggaacaaggtgttttctgtggagaagtggcaggctctgtacaccctcctggaagcctttgggaacagccccaccatcattaatggcaatgccacccgcttctcccagatcctctccctggactttgaccaagctggccaggtggcctcagcctccattcagacaatgcttctggagaagctgcgtgtggctcggcgcccagccagtgaagccacattcaacgtcttctactacctgctggcctgtggggatggcaccctcaggacagagctccacctcaaccacttggcagagaacaatgtgtttgggattgtgccactggccaagcctgaggaaaagcagaaggcagctcagcagtttagtaagctgcaggcggccatgaaggtgctgggcatctcccccgatgaacagaaggcctgctggttcattctggctgccatctaccacctgggggctgcgggagccaccaaaggaagctgctgaagctgggcgcaagcagtttgcccgccatgagtgggcccagaaggctgcgtacctactgggctgcagcctggaggagctgtcctcagccatcttcaagcaccagcacaagggtggcaccctgcagcgctccacctccttccgccagggccccgaggagagtggcctgggagatgggacaggcccgaaactgagtgcactggagtgccttgagggcatggcggccggcctctacagcgagctcttcacccttctcgtctccctggtgaatagggctctcaagtccagccagcactcactctgctccatgatgattgtcgacaccccgggcttccagaaccctgagcagggtgggtcagcccgcggagcctcctttgaggagctgtgccacaactacacccaagaccggctgcagaggctcttccacgagcgcaccttcgtgcaggagttggaaagatacaaggaggagaacatcgagctggcgtttgacgacttggaacccccnacggatgactctgtggctgctgtggaccaggcctcccatcagtccctggtccgctcgctggcccgcacagacgaggcgaggggcctgctctggctattggaagaggaggctctggtgccaggggccagtgaggacaccctcctggagcgccttttctcctattatggcccccaggaaggtgacaaaaaaggccaaagcccccttctgcacagcagcaaaccacaccactttctcctgggccacagccatggcaccaactgggtagagtacaatgtgactggctggctgaactacaccaagcagaacccagccacccagaatgccccccggctcctgcaggactcccagaaaaaaatcatcagcaacctgtttctgggccgcgcaggcagtgccacggtgctctctggctccatcgcgggcctggagggcggctcgcagctggcactgcgccgggccaccagcatgcggaaaacctttaccacaggcatggcggctgtcaaaaagaagtcactgtgcatccagatgaagctacaggtggacgccctcatcgacaccatcaagaagtcaaagctgcattttgtgcactgcttcctgcctgtagctgagggctgggctggggagccccgttccgcctcctcccgccgagtcagcagcagcagtgagctggacctgccctcgggagaccactgcgaggctgggctcctgcagctcgacgtgcccctgctccgcacccagctccgcggctcccgcctgctcgatgccatgcgcatgtaccgccaaggttaccctgaccacatggtgttttccgagttccgccgccgctttgatgtcctggccccgcacctgaccaagaaacacgggcgtaactacatcgtggtggatgaaaggcgggcagtggaggagctgctggagtgcttggatctggagaagagcagctgctgcatgggcctgagccgggtgttcttccgggcgggcaccttggcacggctggaggagcagcgggatgaacaaaccagcaggaacctaaccctgttccaagcagcctgcaggggctacctggcccgccagcacttcaagaagagaaagatccaggacctggccattcgctgtgtacagaagaacatcaagaagaacaaaggggtgaaggactggccctggtggaagctttttaccacagtgaggcccctcatcgaagtacagctgtcagaggagcagatccggaacaaagacgaggagatccagcagctgcggagcaagctcgagaaggcggagaaggagaggaacgagctgcggctcaacagtgaccggctggagagccggatctcagagctgacatcggagctgacagatgagcgtaacacaggagagtccgcctcccagctgctggacgcggagacagcagagaggctccgggctgagaaggagatgaaggaactgcagacccagtacgatgcactgaagaagcaatgtggagcttaaggagaatggtggtagaagcgtcagtaaatctctgccattttagaacagaaatattctcatagtcttcagaaaggcctggaagtttgtgagggcagctcccgacgga

SEQ ID NO: 66759 - DNA, 3024 bp, Homo sapiens
tgcgccgggaagcgtcgcacagcgactgcatcaccatggagccgagggcaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctcccccgggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttattttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgcaaaaaaaaa

SEQ ID NO: 66760 - DNA, 3332 bp, Homo sapiens
tgggcagtggatggcaccaggcaccgtggagcaggagcgtcgctcctcggggaggctctagctgcacaggagcccgccggtgggggtggggaggctcaggcatggcaggctgcaggtcttggggaggcagctaaggcccggcgagaaatagagcacagcagctggtggcccaggtgctaagcccctcactgcccagggccagccgctgtgagtgcggggctccccacgcctacatggaactcgcgctggcccacaagcaccatgcacagcagcagttcccgcccgcgcctctccctccacaccgcccagcaagctgagggagccggcctgggccagtccagaaaggggctcccacagtgcagctgcgggatgaagggctcctcaagcacggccagagtaggcgccaaggccgaggaggcgccgagagggaccgagggctgccagcacgctgtcacctttcaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctcccccgggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttattttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgcaaaaaaaaa

SEQ ID NO: 66761 - DNA, 3101 bp, Homo sapiens
tgcgccgggaagcgtcgcacagcgactgcatcaccatggagccgagggcaggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaacatgctccattggaaattgcctcaccagttctaaggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctcccccgggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttattttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgcaaaaaaaaa

SEQ ID NO: 66762 - DNA, 2703 bp, Homo sapiens
tgtgggcatttggtgggcatttctgtgaaaatttctatagattagctcgggatattgggttcaagtttcttcttccactggacctgatggaaaatccacttctcagcgatgccccggaccgcacagcgatactgattctcggttgtctcttaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctcccccgggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttattttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgcaaaaaaaaa

SEQ ID NO: 66763 - DNA, 1201 bp, Homo sapiens
tgggcagtggatggcaccaggcaccgtggagcaggagcgtcgctcctcggggaggctctagctgcacaggagcccgccggtgggggtggggaggctcaggcatggcaggctgcaggtcttggggaggcagctaaggcccggcgagaaatagagcacagcagctggtggcccaggtgctaagcccctcactgcccagggccagccgctgtgagtgcggggctccccacgcctacatggaactcgcgctggcccacaagcaccatgcacagcagcagttcccgcccgcgcctctccctccacaccgcccagcaagctgagggagccggcctgggccagtccagaaaggggctcccacagtgcagctgcgggatgaagggctcctcaagcacggccagagtaggcgccaaggccgaggaggcgccgagagggaccgagggctgccagcacgctgtcacctttcaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcaggtgccaccagagcgactggggagacaggatagaatttccaaaacatgctccattggaaattgcctcaccagttctaattggtcagtgcctgcccccgtggaccctgcgagatgatgagaacacagggtttcctgcagtgcagggtttcctggactaagcccccttctgtgactgtcgggagacccccaagccacccgtatgcactgatccatacggaacttgtcatagcactgcaggcagatcccaccgccacatcgaatgatcagttactgctggatacgggactgaaaatggctttttcctgagtcttacataaaccgtgttatgagaaccatgaacatattcagcttccctattctttatatgcatgcctgcattagtataaagcggtacacttttgggacattttggttgaagggataattttttagaagcgagtatattgtacataaagatagtggccttcaggattttatattgaataaatatgtcatacagtgaaaaaaacca

SEQ ID NO: 66764 - DNA, 1197 bp, Homo sapiens
tgcgccgggaagcgtcgcacagcgactgcatcaccatggagccgagggcaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagattaggtaatggcacaggttgcaaattagtctgcagtaggagtttgaccctgcaaatcagcctgtaggttatgatgctgtctctgctggcaaacagccagaattactgagaagacatttgtgcttcgtgtggacaaaactactggtcaaataagcatacgtgtccacgtctcccattctttaatcccaaatcattcaccgtttgaatccctcctttgggcatggaaaattaacaacatcacctctaaggatgaacacagaatacctgctgcttttgccacagcccagccgggactttccctgcaggtgtcctgggcaggcactgctggggactcccaggtgtgcactcctcggttggccgctgatgaacgcagagggaacagcctttgtaacccagagtgtatgggcggccctctaagcgcaccaggagcactgggaaagaaggtggtcactgctcttccaggaaatgaaaatatcccttgaaa

SEQ ID NO: 66765 - DNA, 3024 bp, Homo sapiens
tgcgccgggaagcgtcgcacagcgactgcatcaccatggagccgagggcaggtgtctccaaacaggacatacgtgaacaaatttggggctacatggaatcacaaaatttagctgactttccccgacctgttcatcacaggatacccaactttaagggcgcttctcatgctgccgagcaactcccacgcttgcaggcgttcaaaacggccaggaccattaaagtaaatcctgatgccccccagaaaagtgctcgcttcttcgtccttgaaagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctcccccgggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttattttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgcaaaaaaaaa

SEQ ID NO: 66766 - DNA, 2806 bp, Homo sapiens
tgcgccgggaagcgtcgcacagcgactgcatcaccatggagccgagggcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctcccccgggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttgccgtgaaaatcctgtggagacttcgcaaagaaaacgcagccttacatttgctcattaaagacagatttccttcccaagtcgccatgaataaaatgagagagtagaaacgtctggaagcgccacacctggccctgggccctcggccctctgtgtccttggccttgcccccgcccgcacggctggtcacgtttgtcattgggcattcagctcagcgtcagaggctgactcagtccccagttcagagtagtcacctggttacactgaactcctcaccttcttttctctctttttttaaaaaatacttctttttctgaaagattcttattttttttttgtttacctttttcctgtggatttgctgccgttagaatagcaactccaggagaagagcaagtgagtcagccccccttctccactccctgccccaccggcagtgggcacagccctgcagacaggagcaaggacttcggggaatagacccactggggccgggagagggagaagctggattctgaccccaccactggcactcctgtgtccagccatgcctgacgcccaccccaccctcagacggcgggattaaaccaggcagtacagggttactcggggaagccagactgctgggatttcctgtcgctttagccagaataatccaggtatatggatatacagataatctgaaagagtttctcatttttatatttgtggaacatcgtgtaagaaaaactgaagagcaagtgcctgaaataaaatcccccacatgtatcagcctgcaaaaaaaaa

SEQ ID NO: 66767 - DNA, 2381 bp, Homo sapiens
tgcgccgggaagcgtcgcacagcgactgcatcaccatggagccgagggcaggtgtctccaaacaggacatacgtgaacaaatttggggctacatggaatcacaaaatttagctgactttccccgacctgttcatcacaggatacccaactttaaggggtcttatctggcttgccaaaacatcaaagacctagacgtttttgccagaacacaggaagttaaagtggaccctgataaaccactggaaggcgttcggctgctggtgctgcagagcaaaaaaacattgttggttccaacaccacgactgagaacgggattgtttaataagatcacaccaccccctggggcaactaaagacatcttgagaaaatgtgccacctctcagggtgtgaggaactacagtgtccccataggcttggactccagagtcctcgtggatttagttgtggtgggatccgtcgccgtttctgaaaaaggctggagaatcgggaagggagaaggctacgccgatctggaatatgccatgatggtatccatgggcgccgtcagcaaggagacgccggtggtcaccatcgtccacgactgccaggtcgtggacatccctgaagagcttgttgaggagcacgacatcactgtggactacatcctcactccaaccagagtcatcgccacaggctgcaagcgcccaaagccaatgggaatcacctggttcaagatcagcctggagatgatggagaaaatccccatactgaggagcctccgcgcccgagagcagcaggctgggaaggatgtcaccctccagggtgagcaccagcaccttccggaaccaggctgccagcagacagtgcccctgagtgttggcaggaggcccccggacacacccggaccagaaaccaattccatggaggcagcccctggctccccaccaggggagggtgccccgcttgcagccgatgtttacgttgggaacctcccccgggacgcccgtgtgagtgacctgaagagagccctgcgggaactcggctccgtgcccctgcggctcacctggcagggcccgcggcgcagagccttcctccattacccggactctgccgcagcccagcaggccgtctcctgcttgcagggcctgcgcctgggcaccgacaccctgagggtggcgctggccaggcagcagagggacaagtgacctcgtggacagccacggagctcactgcagactcgccatccccgtcccctgccgctccggttccgatggcactcgagaggcctgcgtggcaagacgtgtcggagccaccgcctgagctgctcgggtctcaattcttctcagaagtcaccgctcagtgaacgcccaggccctcctgtgagtggggaagccgccctgcggttcatctcacagcgcgcagagactgcagcctcccaatcgtgcaggctcgggccttgagtcggtttctgtttctctggagggacagagcagaggggccagggactgagtgagtggctaagcaggggagggtgatgtgaaggtgatctcgagtttgccaggggtgggctgaacaggagaagatgaacaaaggatccggctctcaaaaggccctggcagggactggatgctgggtacagaagcgcgcccttgggcttcaggctcctgagctggcagcacggcagggagagctccatccatgtcgcaggagcccaggaagctcagcccctgggtaaaaagtgctcactgcagctcagatcagtcctcaggtcacatttcggggagccagcctcccctcttcccctccccagccccgctcctccctctgtggacacactccgggccctcagccagctggctgcatgaggagcagctttgtgctgtgggagagaccggctctgggagaatgggtttcatcccagcctacgtcacatttgcccagtgccttatgttttctgggtttttttcctccagttctgtttctaaaaaccagcttgagtttggctgaactgtcctttctcaacagaagcgcttttgcaattgatcccgggcaacaagtcaaaataagcttttaagtggagattttgtttttttcaaatgtatatgctttggaaattttgattttttagccagagggttttaccaagtgttctttgaagcacattacgatgcctcgagagggcggcccgtgcacgcgctttcaagaaaatgttctcgggacactcggtcttctctttgaaaggacattttctcattggttttccagaataatccaggtatatggatatacagataatctgaaagagtttctcatttttatatttgtggaacatcgtgtaagaaaaactgaagagcaagtgcctgaaataaaatcccccacatgtatcagcctgcaaaaaaaaa

SEQ ID NO: 66768 - DNA, 3547 bp, Homo sapiens
agcaattgtcccctttccaccctacatcaaaatttccctttgtaactggatatatttctcaccctccacacaagctgtatttctcccatctttaaaaagattaaaaaaaaaacccagaaacacccagctctatcttctcctcaagctattccatcccctccttatgcatccattctttctatttgttcttgaatccattcaaccaaagtaactcagatccctgccattgcaccaaaacaattatttcaagatcacctatgaccttcaagtcaccaaatccaatagtcattactcagaaagtcagatcctcttacttaaccagttggcaatatctgacacagctggttgttaaatcctccttaaaacactttttgtactttgcttccaattcatcacacacttctagattttctccttctgcagtggcttctcctctttgtttttgttttaaagatagggtttcactgtgtctcccaggctggagggcagtgatatgatcagctcactgtatcctctgactcctgggctcaaacggccctcccacctcaccctctccagtagctaggacatgtgggataggcacatataggcatgtgcaagtgtgctcagctaatttatttgttttatttattttattttatttatttatttatttttgagacggagtttcactccagcctgggcgacagggtgagactgtgtctcaaaaaaaaaaaaaaaaagttgaaaggattctacagtggacatccatagatttattccaaattctaaagttgttaacagctcgttatactgcattctctttatcacatagtggttgttgaaaggtttgacaggaacactgatgcttcaataatggttttggttcagtttgttagtctgttgaacttcaggatcgtgtcttagaatatatgttcgaaaggataaaaaccgtactttaattttgggtttcaaaagcctacccctgcaacaaaatagaagctcaataagtgtgtcatcctcaaaatatccgtgggtcttttgtctttataatattctgacaccaaaagtgagagaagtagtagttgaattttatgatctgcattgttaaatgagggcttatcttccttaacaaataataacatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataa

SEQ ID NO: 66769 - DNA, 317 bp, Homo sapiens
tcatcaaacccttaggatggggtgtgataggtggcacggagaattttgtattctcagggagggtttcgatgacgtcatcaaacccttcatcaaacccttcatgaaaccctcagctttccgaaggatgggaaatacccaagtatcctacatagtgaatgaagatcttttatgcatcttgccactaagttcacctttaaaacaatttccaaattttgcagaccatgataactattccttaataaaattcactaaaggtaccatcaagtcttcagccacattgtttctctagaagggtagggtttcggtgcggggtccta

SEQ ID NO: 66770 - DNA, 3282 bp, Homo sapiens
tgtgcagctttcgcggcctgcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccagtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataaaaaacacaacacacaacccacacaaacaccccaccaacagcgaacaaaaaaaacacaaaacacaaaacacacacacccaaccacacaacacaccaagacccaccaaccaccacaaaaagcaggcagacggcagggaaaacacttccgaggggaacaacacgacctcgcacaatgctatatgatacgagcgagcactagtcactagtgttggtcgtcaaatatagccagaggaggatgaacatatacaccgactagggaggagaagaaaaattgagctgagattttagtatggtaaaccaccactctcggtggtcgatcatggaagaccaactcaacatagaccatgcggagacaaccatgggatgagtcaccagttcgcacgaaagcgaagattataacgacgaa

SEQ ID NO: 66771 - DNA, 2916 bp, Homo sapiens
  misc_feature (2745)..(2745): n is a, c, g, or t
  misc_feature (2856)..(2856): n is a, c, g, or t
tgtgcagctttcgcggcctgcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccagtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttngaaaggatacggatagaactatttgatactatagtgtcagtgactggcagatatagtatcacatgcctcctatgattgggcatgatgatctgggtatagcgtacggtgacngcatactgatctcggagagcccgctaggcagagaggtttacgattacttagccactccgg

SEQ ID NO: 66772 - DNA, 2837 bp, Homo sapiens
tgtgcagctttcgcggcctgcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccagtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacaccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataa

SEQ ID NO: 66773 - DNA, 1598 bp, Homo sapiens
tgtgcagctttcgcggcctgcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccagtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacatctgaatcgagctccatgtcggcgggagatcccgc

SEQ ID NO: 66774 - DNA, 343 bp, Homo sapiens
ggaaaagtaacataagaaggaaaaatgtaatttgagatctccactgtacctcctttgagcaaaatctcaaaacatgacattttccaaatacatgtgttttttttttccttctcttttcatcattaggaatggaggatctttggttccataccaatgcaggcatgtcagcagaaggatgtgtttgccaattaccttacttctaacttccaagcggtaaatagattttaagggtgtgctctataaaatgttgttgtgtctgcgagattgtgtaatttattagcgtcttacagccttttcttgctttgttatcttgacaaaccaaaaggaaaacagtggcaaaatt

SEQ ID NO: 66775 - DNA, 471 bp, Homo sapiens
gactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataacataatctaagactttgaata

SEQ ID NO: 66776 - DNA, 4370 bp, Homo sapiens
ggcagcgccaggcgtggggccggggcagcgccgggcgagggcgagggcgcgggcggaagttccaggagggccagaattccaagtgatttctgtcacccgccggcggaccgagagtctagggttcggggcgcgcaggctgcctcggcgcagacctcttcccctcagggaggccgtctcctgaccagacccactcctgcctcccacccgggtgccgtgtttagggttattttaggctgctcacctgacagattgtacacaagcccttaattgcccccctctgtttgaggtcgtggtgaggtttcatatttcgcagccacgctcaaattgtgccgtcatgttacagttgtaggtgatgaaataccggctgcttagacgcgggatcggtttttataccggggcaaacgctagtggtcccagaatgcagagttgggggcctcaaggaatccgggtgtgctgagataattggttaattgcttgattaaaattggggattaattttagagttcttccactcggagctcgcttctgtgctgaagatgctttgcaacgccttgaggaaaacgcgccaaagaagtttctgttagacttgagttacaagattgcagatttttcttgatttgctagtatgtttttttttacgttcgtagagttttataggtagatagataactttggttcgggtagttttccttttaaaatttgtagagaactgaaagtggctgatatgttagcttttttagggggacggggtcggggaatggagtctcagtctgttgcccaggctggagtgcagtggcgcgatctcggctcactgcaacctccgcctcccgggttcaagcgattctcctgcctcagcctcccgaatagctgggattacaggcgcccgccacggcgcccagtcagtatatcagtttttaaggtttgtgaagcgcgatttattttttcagaatgtcgtcttcctccacattgtgaggaaaattttcagaatacaaaaagttgaggccgggcgctgtggctcaagcctgtaatcccagcactttgggaggccgaggcgggtggatcatgaggtcaggaggatcatgaggatcaggtggatcatgaggatcaggaggtcagcctggccaatatggtgaaaccccgtctctactaaaaatacaaaattagccgggtgtggtggcgcgtgcttgtaatcccagctactcaggaggctgaggcaggagaatcccttgaacctgggaggcggaggttgcagtgagccaagatcacaccattgcactccagcctgggcgacagggtgagactgtgtctcaaaaaaaaaaaaaaaaagttgaaaggattctacagtggacatccatagatttattccaaattctaaagttgttaacagctcgttatactgcattctctttatcacatagtggttgttgaaaggtttgacaggaacactgatgcttcaataatggttttggttcagtttgttagtctgttgaacttcaggatcgtgtcttagaatatatgttcgaaaggataaaaaccgtactttaattttgggtttcaaaagcctacccctgcaacaaaatagaagctcaataagtgtgtcatcctcaaaatatccgtgggtcttttgtctttataatattctgacaccaaaagtgagagaagtagtagttgaattttatgatctgcattgttaaatgagggcttatcttccttaacaaataataacatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccaagtatcctacatagtgaatgaagatcttttatgcatcttgccactaagttcacctttaaaacaatttccaaattttgcagaccatgataactattccttaataaaattcactaaaggtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataa

SEQ ID NO: 66777 - DNA, 1829 bp, Homo sapiens
  misc_feature (17)..(17): n is a, c, g, or t
  misc_feature (19)..(19): n is a, c, g, or t
gaaccttttttggccangngattgtgtcaggtagtcttttagtattcagtcttaattattttgcaggcaggtttagttttccttcaacacattattttccttaatttccaataaaggaaaagtaacataagaaggaaaaatgtaatttgagatctccactgtacctcctttgagcaaaatctcaaaacatgacattttccaaatacatgtgttttttttttccttctcttttcatcattaggaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataa

SEQ ID NO: 66778 - DNA, 872 bp, Homo sapiens
tgtgcagctttcgcggcctgcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccagtaccatcaagtcttcgcacatggttctctagaaggcagaaatcagtcacggaaggcaagctcctgttcatgggctgaaacacatgaaatgccagcctggatgggcgatatgagcaag

SEQ ID NO: 66779 - DNA, 2877 bp, Homo sapiens
tgtgcagctttcgcggcctgcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccagtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataa

SEQ ID NO: 66780 - DNA, 2708 bp, Homo sapiens
tgtgcagctttcgcggcctgcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccactcccaaagggcaccccgccgctgactcccagtgactcaccccagaccagaacagcatctggagctgtggatgaggacgcactgactctagaagaacttgaagaacagcagaggcggatctgggcagctcttgagcaggccgagagcgtaaacagcgactccgacgttcctgtggacacacctttaactggcaattccgttgcctcatcaccttgtccaaatgagctagacctccctgtcccggagggaaaaacatctgaaaagcagacgctggatgagcctgaggtaccagagatttttacaaagaaatcagaagctggacatgcctccagtccagactctgaggtgacatcactttgtcagaaggaaaaagcagagttggctccggtaaacactgaaggtgcccttcttgataatggcagtgtcgtaccaaactgtgacatcagcaatgggggcagccagaagctctttcctgcagacaccagtccttcaacggccactaaaattcatagccctatacctgacatgagcaaatttgcaactggaatcacgccatttgaatttgagaatatggcagaatctactggaatgtacctcaggataagaagcttgttaaagaactcaccccgaaaccagcagaaaaacaaaaaggcctctgaataatggcttgacttagcactgagagctatttaataactttgttccgttaattagtactaattaagtggatagatagaatggttttcctgtttgtccctcccatgtttaaaaatctatccaaggttcatgttccaaagtcaagcctattttaaagaaagactgagctcactagttcagtatattttattctcactgacaaaacttggggggagatgtgaatatgacctggtttagagagggtttgttaaggtttatactatttttggattgtgactatccgtcgagagtgatggtttttatctgtcttttgtacattgttttccctttctacattttgctaattatcctgtatataagtttaatatatcactttttaaaagaaaaaattctaccattttaaattcatgtttcaactcctacaaccaaatgagaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatatacataa

SEQ ID NO: 66781 - DNA, 1651 bp, Homo sapiens
tgtgcagctttcgcggcctgcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccagtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgaatggaggatctttggttccataccaatgcaggcatgtcagcagaaggatgtgtttgccaattaccttacttctaacttccaagcgccaggtgtgaagtctggcaacaagaggtcttcatctcactctagcccaggtagtccaaagaagcagaagaatgaaagcaactcagcgggatctcccgccgacatggagctcgattcagatatggaggtaccacatggttctcagagcagcgaaagttttcagtttcaaccaccattacctcctgacactcctccactcccccggggaactcctccacccgtcttcacccctccgtgtgccccaggtgccaccaataaaaatcctacagaaaattc

SEQ ID NO: 66782 - DNA, 1479 bp, Homo sapiens
tgtgcagctttcgcggcctgcgtctggagaaaaccctagcgggtggctccgtgcggccagagctctagagagtggtgccgccttccaaccttcttccccaagccctggtggccggctccgcctcttctcgaatcttttccacagcccaaaatggccgcagaggtgtattttggcgatctagagctcttcgagccgttcgaccacccagaggagtcgattccgaagcccgttcacactcgcttcaaggacgacgacggcgacgaggaggacgaaaatggggtcggcgacgcggagctacgggagcggcttcggcagtgcgaggagaccatcgagcagctccgcgccgagaatcaagaacttaaacgaaaattgaacattctgactcgaccgagtggaatattggtgaacgatactaagttagatggacctatattacagattctattcatgaacaatgctatttcaaagcaatatcatcaagaaatagaggaatttgtatcaaatttagtaaaaagatttgaggaacagcagaaaaatgatgtggaaaagacttcctttaatcttttgccccagccatccagtattgtgctagaggaggaccacaaagtggaagagtcctgtgccattaaaaacaacaaggaagctttcagtgttgtaggaagtgtcctgtattttactaatttttgccttgataaattggggcaaccgcttctaaatgaaaaccctcagctttccgaaggatgggaaatacccagtaccatcaagtcttcagccacattgtttctctagaagggcaagaaatacaagtaaaggcaaaaaggccaaagcctcactgtttcaattgtggttctgaagaacaccaaatgaaagattgcccaatgcctcggaatgctgctcgaataagtgaaaagagaaaagagtatatggatgcctgtggagaagcaaacaatcagaatttccagcagcgataccacgcagaagaagtagaagaaagatttggaagattcaagccaggagttattagtgaggaacttcaagatgcactaggtgtgacagacaagagtcttccaccttttatctatcggatgcgccagctagggtacccaccagggtggctcaaagaggctgaattggagaattcggggcttgcactctatgatggaaaagatggcactgatggggaaacagaagttggagaaatacaacagaataaaagtgtcacttacgatctctcaaaattggtcaactatcctggttttaatatatctactcccagaggaattccagacgtaagtatattgatttttttaaattatcgtgtgatgtgatattattatgttaaagattggtcaaaatattaacttgttggctaggcatagtggctcacacctgtaatcccaacactttgggagtccgaggcaagatgatcacttgagtcccagagttcgagaccagcctgggcaacatagcaagaccttg

SEQ ID NO: 66783 - DNA, 1131 bp, Homo sapiens
  misc_feature (4)..(4): n is a, c, g, or t
tccnccgggctgaggaattcggcacgagtgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttaaaaaaaaaaaaaaaaaaaaaaaaaaaaagggggggggggccctaagaaggatactcccctgagaggggcgccacaaggttatacgcgcggatccccaggcttccgggcgacacaggggggccccatataggggaggccggaataaaaaccggcaaggcgcaagggagccggaggagtttaaacaacggcacgggagacggggcgaacaagccgggcaaacccgggggggcactccctgtgggggaaagggggaaacccctttacactcgcgggggggggggcgcaccaccatacatgtggggaacaaaaaatatgaacctttagaggaaaaggtttttcgaaaaagcgcctgtaagggggataacattttgtagacaactctgtaaaacgagggggtaatatcgcgctggtgggttaaaaacctaataagcgggggcaataggtgccttgagaaggggacttttgacgaaagtttgggggcatcacggcgggagaaacgaagaatttgatagcaaaaattttctttattcccccggggac

SEQ ID NO: 66784 - DNA, 435 bp, Homo sapiens
ggacaatatgcttacctgtcgataaacagtgcaagacggtgactagaggatagtgtatatttgggagctgcggtgtgttgcaagcgtggaggtggggggatcggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66785 - DNA, 425 bp, Homo sapiens
tcagcaccataggatgataactatatatgatgaggatgggtgtttgctaagtcgcaaacctgcctagattaaggaaaacagaagtcatgggtgaccatgagattttggaagctgcagaacttaacacaaaattgagttcagcttcttggaaagataactggaaatcttgttgttttcatctctcacaatttcctctactatcttcacataagattcgccagtctccatctcctctcttcaacaaacgccagcttctgttactgatgtaaggatgcagagtcctgtcaggagttaggtgtcaagtgaagtctccttgttatggggcagtgcagctgtaggccaagctgtatctgtttgggaagggagaaaaaacagtagctggcatccatatccacttctccgggtgagtggtgctggagaggtat

SEQ ID NO: 66786 - DNA, 386 bp, Homo sapiens
ggctccccttctttttgagggtctccgtctcacatatggctttcgaaacatggagaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66787 - DNA, 2887 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66788 - DNA, 2670 bp, Homo sapiens
  misc_feature (20)..(20): n is a, c, g, or t
tatgtataccccccgagtantacgaggcgtggtggccacaagggggctcgcgcgtgaagttgttatcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66789 - DNA, 2467 bp, Homo sapiens
aggctaggtagaggccggggttaatcggccgaggttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66790 - DNA, 2823 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaataccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66791 - DNA, 2927 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgggtaggagacagatgtgtcagctttaagtttttacttgcgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66792 - DNA, 1582 bp, Homo sapiens
tggaagcaaacataggctaggtacgaggctgggtgtcgcaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66793 - DNA, 3428 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttaaaaaaaaaaaaaaaaaaaaaaaaaaaaagggggggggggccctaagaaggatactcccctgagaggggcgccacaaggttatacgcgcggatccccaggcttccgggcgacacaggggggccccatataggggaggccggaataaaaaccggcaaggcgcaagggagccggaggagtttaaacaacggcacgggagacggggcgaacaagccgggcaaacccgggggggcactccctgtgggggaaagggggaaacccctttacactcgcgggggggggggcgcaccaccatacatgtggggaacaaaaaatatgaacctttagaggaaaaggtttttcgaaaaagcgcctgtaagggggataacattttgtagacaactctgtaaaacgagggggtaatatcgcgctggtgggttaaaaacctaataagcgggggcaataggtgccttgagaaggggacttttgacgaaagtttgggggcatcacggcgggagaaacgaagaatttgatagcaaaaattttctttattcccccggggac

SEQ ID NO: 66794 - DNA, 1364 bp, Homo sapiens
gtagttggacttggcagtgtgcagcgctagagaggaattgtctgaccccagcattgcttcctggctcctttcttcctttttcaggagagcatcttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66795 - DNA, 1812 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66796 - DNA, 880 bp, Homo sapiens
agctccgtaccccgatacttggagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66797 - DNA, 512 bp, Homo sapiens
  misc_feature (27)..(27): n is a, c, g, or t
gatccgccttcgtgccgctcgtgccgnccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66798 - DNA, 433 bp, Homo sapiens
agctgacgggtaccaatcttcatgctaagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66799 - DNA, 2849 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66800 - DNA, 2014 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccacggctcccaataaaaatgtgaaaaccaaaaaaaa

SEQ ID NO: 66801 - DNA, 1248 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagaatcagcgtggggtgcgagctcg

SEQ ID NO: 66802 - DNA, 1313 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaataccttctaacctgcaagactgcccgccaactgacagtgagaatcaagaacctcaacatgaacagagctcctgacaacatcattaaattttataagaagaccaaacagctgccagtcctgcaccggctcccattctggttggccagtctgcc

SEQ ID NO: 66803 - DNA, 635 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacgttgaggaactatctgtccaacctactacatcaacgacatcacattcgacgacgttctatttcgacaccctgttacta

SEQ ID NO: 66804 - DNA, 608 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacggtgagtagaacgatttgggccggcattcgggcctaagcactctctcagcgattgaatcctgggctttctgggagccactgtcatctcccggacctggacctctgggagagcagtggtgaagatgggggaggggagagcagggagggggatcctgagcctaccgggaagtccctccaggcggggtgaaggggtgtc

SEQ ID NO: 66805 - DNA, 2629 bp, Homo sapiens
  misc_feature (1179)..(1179): n is a, c, g, or t
atttaaaaattgcagactttatttgcatttcctcagcttttctgctaatgtcttctttctttttttgagacagggtctcgctctgtcacctaggctgcagtgtgatggcgtgatctcggctaactttgcaacctcttcctcaatcctcctgcttcagcctcccaagtagctcagactacaagcgtgtgccacacctgtctaatttttgtgtctttttgtagagatggggtttcaccgtgttgcctaagctggtctcgaactcctaggctcaagcaatgcgccctcctccgcctcccaaagtgctgagattacaggtgtgagccactgcgcccagcctaatgtcttctttctgttacaggatccagtagaagattccacatctggagatcttttcctttctttatatctatcaccgacattacctactctttaaaaattttgtaaaaggcataaatttgaaaaatatatcctcattaatctaaatcaagtcattgatacaactatttaacaagacgcccggcctgctttgttttattaacgacttggagctaattccactttacatatattattatttcgtgtgtgtgtgtgtgtgtgacggagtctcgctttgtcgccaggctggagtgcagtggcgcgatctcggctcactgcaacttccgccgcccgggttcaagcaattctcctgcctcagcctcccgagtagctggggctacaggcgcccgccaccacggccggctaatatttgtatttttagtagagacggggtttcaccatgttggccaggattgtctcgatctcttcaccttgtcatccacctgcctcggcctcccaaagtgctgggattacaggcgtgagccaccgcgcccagccctatcttattatttcacacaccaaccctggaggcatgtttggagttgcctaatttttatgtacactttttgataaggaactaacaaaaataacttgctgaagacaagggaaactgagtccagaactgaatgagaagcacatggtttcttcatcctccatcaccaggctgtctaacgaggctgaagtaccatccatgagtaagtgcgtcaagggcaaacaaacatcatcgcatatggacagtggtgtgaaattcgagaaatccgaggagggttaacaacaacaaaaagcacaccaccacgccgaacntcctcgggtcccaggttggcaactcaacgcccgggaggaatcccccccggaggcgcgccggtctaccggcctcactccctacctcctggaggtccggagtcccgctcctttccctcagcggtacaatacccgtgtcggtccattccctcaccgtgagtcgaggactagttctccagactaggcgaccgacacacgctgcctggggccggctccaaagcgcccgtcctgagactgcaaaaaagggtcgggtcatccggcaggaaacgactcaacgcgcagccgccgcggcctccaaccaccggccggcagaggggcgctaggccgccctcgatcccctcgccgcggtcccatggaggaggaggcgagccgcagcgccgcggcgacgaacccagggaggtaggttgtcatgggactcggccggccaccctggcaattccagtcaaacggcaagccagactcgctttgccggtcccttcctctcctgcccctgcagccgccaggaatggaacagtcccgcggtggggactgtgggaggcgcacgcgcgaggagtgtagggtgggggtgctggcggcggctgctttggcggcggttggtggccgtgcgggcggggagggagggggaggagagaagaggaggtggagaaggcttgggctcgcgccgctgaaggtacgcgtgagggcctgcgctggagccggcttgacagggtctgagggggagtggagaactgggcgaggaggttcccgtgggtgagcgcgtacgggatggctggctcgcaggacggccgaaggtggtggttggtgggagcagccagcgacgagcccgtagacactcgtacgcgtgcgggctgacgtgcgcgctacatggccggagtcgggcgaagcgggggaccgtggggaagaacgcgaggagggaggagtgggaggttgggggtgtcgctaggcgcccttagctccctccctctggaggagctgccgcggccactctgctgccgccgctgccgccgccattttgggttcgctttgcgaggggaaacgatcccagtgtcggttgcgggatccgcctcctctcagtttgcccctttagccctccacctttcccttctcctctctcgcatttccgccagtcggcttacccgctggccgcctcctgacaagcgggagggatccgcggtggacccagggaagcggaggagcctggcggccaccccctcttcctcacttccctgtactctcatcgctctcggcctccgacacggtgagtagaacgatttgggccggcattcgggcctaagcactctctcagcgattgaatcctgggctttctgggagccactgtcatctcccggacctggacctctgggagagcagtggtgaagatgggggaggggagagcagggagggggatcctgagcctaccgggaagtccctccaggcggggtgaaggggtgtc

SEQ ID NO: 66806 - DNA, 2663 bp, Homo sapiens
tatatgtcgaccagcgcctcggaggaggtggggaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66807 - DNA, 2659 bp, Homo sapiens
ggctattgtagaggctgggtggccccacaggtgcttgggctcgggccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66808 - DNA, 3280 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggtacagccctcttcctcgaagtctgtaggaggcagaaggtcactgaaagttctgagagaatatcaaggacttccttaatcgtctaatgctttagttgtagaactaggacttcaggaatcttcctgattcacctttcttcccttacttttctgcccttctccgggtgattctacaacattttcaaaataatgggtaaaatggtaatttgctaaaggaaattcagagaagagtttctaaagtgtataattggactgtggtctttgtagaaatttcatatgcagagtcccttggaaagatgccttgagcttgtctcaggtccctaaacttagaaagtcctattctttttcccaaattctgacatgtgctggatcagagtgttctcatttccaataggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66809 - DNA, 2913 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttatcttccttgtgtcgtgttttcccagaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66810 - DNA, 2166 bp, Homo sapiens
  misc_feature (14)..(14): n is a, c, g, or t
tcgcgaacgtagtnatccctagcagcagatgagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66811 - DNA, 1995 bp, Homo sapiens
tggaagcaaacataggctaggtacgaggctgggtgtcgcttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66812 - DNA, 2907 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttaaaaaaaaaacccgggctca

SEQ ID NO: 66813 - DNA, 1400 bp, Homo sapiens
ttctattctgcgctgagagctgtacagcagcctactcactcttggggtctcctcacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66814 - DNA, 1123 bp, Homo sapiens
tgagtgcgtgccgggtgtttatttcattccgaggccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66815 - DNA, 841 bp, Homo sapiens
atttcggcacaggctagcccatgagcttcaataccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66816 - DNA, 479 bp, Homo sapiens
aagtgcacaagcattgcatggccatgcaaggtcagactgctagtaggatccccagtctgtcatcactaccaagagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgctt

SEQ ID NO: 66817 - DNA, 2682 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagcaaaatggtgctccggattcctcacccaatacagccagccactgttttacagacagttccaggtgtccctccactgggggtcagtggaggtgagagttttgagtctcctgcagcactgcctgctatgccccctgaggccaggacaagcttccctctgtctgagtcccagactttgctctcttctgcccctgtgcccaaggtaatgatgccctcccctgcctcttccatgtttcgaaagccatatgtgagacggagaccctcaaaaagaaggggagccagggcctttcgctgtatcaaacctgcccctgttatccaccctgcatctgttatcttcactgttcctgctaccactgtgaagattgtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggaggcgacgcgaccgcagataatccgcatggtgatcagcagatcatcggcttattcacgaagtcataattattgcgcatcgcccgcggaagacgctgatacgcgtgatgacaggcactgttagtacgatga

SEQ ID NO: 66818 - DNA, 1790 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgccaatgaatttccctgtttgccaaagcaagtggcttggatcctggccacaagcaaggttttcatgtatccagagttacttccagtgtgttccctgaaggcaaagaatccccaggataagatcctcttcaccaaggctgaggacaatttgttagctttaggactgaagcattttgaagggactgagtttcttaaccctctaatcagcaagtaccttctaacctgcaagactgcccgccaactgacagtgagaatcaagaacctcaacatgaacagagctcctgacaacatcattaaattttataagaagaccaaacagctgccagtcctaggaaaatgctgtgaagagatccagccacatcagtggaagccacctatagagagagaagaacaccggctcccattctggttaaaggccagtctgccatccatccaggaagaactgcggcacatggctgatggtgctagagaggtaggaaatatgactggaaccactgagatcaactcagatcaaggcctagaaaaagacaactcagagttggggagtgaaactcggtacccactgctattgcctaagggtgtagtcctgaaactgaagccagttgccgaccgtttccccaagaaggcttggagacagaagcgttcatcagtcctgaaacccctccttatccaacccagcccctctctccagcccagcttcaaccctgggaaaacaccagcccaatcaactcattcagaagcccctccgagttatccaacccagcccctctccccag

SEQ ID NO: 66819 - DNA, 1838 bp, Homo sapiens
ggcacgaggcctccccacaccacctcatcactctcctttacttggctgccagtccagctgcctcagaatgtcagaagggtgccattttcagttcttttcctgtctgactgtagggtatagaacaggcagccctaagtgctgctttctgcgcaaatgttttttgattacaaatctctaactaggtttgaaatgttttatagaataagacaatattcttttcaacaaactttaaaaaaaatgtacagttttgttgtttgaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgatggaagatctgtttgaaactttccaagatgagatgggattctccaacatggaagatgatggcccagaagaggaggagcgtgtggctgagcctcaagctaactttaacacccctcaagctctacggtttgaggaactactggccaacctactaaatgaacaacatcagatagcgaaggaactatttgaacagctgaagatgaagaaaccttcagccaaacagcagaaggaggtagagaaggttaaaccccagtgtaaggaagttcatcagaccctgattctggacccagcacaaaggaagagactccagcagcagatgcagcagcatgttcagctcttgacacaaatccaccttcttgccacctgcaaccccaatctcaatccggaggccagtagcaccaggatatgtcttaaagagctgggaacctttgctcaaagctccatcgcccttcaccatcagtacaaccccaagtttcagaccctgttccaaccctgtaacttgatgggagctatgcagctgattgaagacttcagcacacatgtcagcattgactgcagccctcataaaactgtcaagaagactgggtaggagacagatgtgtcagctttaagtttttacttgcggtgagaggtggtgggaatcttatcccatagataacttcctaggatacttgcctaggaatggaggacacaggacatttgtaatttcttccttctctcttttatcctccctttgtactcattatccaagttctagaattacatgataatctccgggcctgggtaaggcatggaggcagtggacagtataggaatatgggaggtagagatctgaggctcagtgctaagaattggactacagcaatatgaggggtaagtattaggaatcagatcaagataaactggggcctggtaaagatgaaagtcaggtggtaaagttcggtcatgtttagctttttattctcttcattaagatcaactaactttatttaccataatgattgtagcataggtgatatctccattctgaatgaaatgttgacttgcaagttaggcgtaaattagagattgtacatttgccgtgttcagtattttaaagaaatttgccggtttagattctaccttgcattggtttagtattttttgagaaaatatttgctatttacttaagccaaatatttacttctgatttgtttgctgacttagcaaattagttgtggtttgttctggatttgggtttgtctttggattctattttaaatccctaagtcttatcattacattgaatgtagttgaatttaagtgtactatatcatagacacagatcccaaactactttaatagctatattatatgaaatggtaatgaaaacgtgatttaataccaaattatagtattatcttaca

SEQ ID NO: 66820 - DNA, 610 bp, Homo sapiens
acacaaataccacattcatcctcataatgacaacatgccaatggtataagagaaatatctctaaatactgaatttagtttatgtaccagagaagtacctaaaaagtcaaaccacatcaatctcaagaatcactacaaggagaccacaaaattaaaagcattctctattctgaactgcattttgaggatttcaacataaactttggaggagaaattaaaactgtgtaggaatactactgttccctcactgcggaatcagtagcacaattcactccttggttgattgtggtagcttttagcaaagaaggaaatatgggacttttgactgtgttcctgcttttcatggacatggtagcctccacagggagaaattatatggaagtaaaataattttgtacttactgaaaaacattaaaggagtaataaagggggaaaattatactcgttttgactgaaactaaagtccacaagagcagtgcccacagggcatgcactactgaaaaacagaacctcccttctgcctgctgcctgctcccagaatggcctacatctccttcttcacggttgatctcaactgattacgtctctaatactgtactgagcacataaaa

SEQ ID NO: 66821 - DNA, 292 bp, Homo sapiens
tttttaaaaatcatgtatcgtgatatttaccaacagatattaaaagttgagatgtgaactgttttccctttaatttcgtcctaacaaaaagttgagccttaagtggggtaaaaatgtttctgaaaatgagctaaacatgaaatggctttgattaaagattatatttcaaaatatttattatatttatatttgatttagcagattttatttatataaatttttgacatctaagtttggggtgaacattatttttatgttaagttggaccatatgaaattgtcatttttttagg

SEQ ID NO: 66822 - DNA, 470 bp, Homo sapiens
tactgatctgtggaaggggtaggtgaagggggagacagtgcagatataagactaaataacgccgaccaaatagtacactgctgagcaaacaaagaaaggggcagaaacagaatgcagggcattgaccctctcactcactactgctggaacatgaaggcgcctagtggtcttcaatgatccaatttatttgattgcatggggttagagcatattggagaagatatcacagaagcgcattccccacagcatttcagctaccattcagcagtaggaaataaacacccccatttgtgccacaaaggggaaaattacattcatttctggccaggggaaaatctctggaataatatgatgaattgaagaaatcaaaggatttttttataaaatctgctttatcaaagccatttattttctgagtctctttttagttccttttctacacaattaactctgaaaggatgtgtgtaaac

SEQ ID NO: 66823 - DNA, 201 bp, Homo sapiens
tggggtcagagagtcctctttctattatgactcagatgtgaagggaagatgccaagggccctaaacatcacagggccttgcctggcatcaaacagatattaaataaatatatgttaaatgaatgaacaaatattcacagcgtgtgccgccctggacttgcagtgccatggtcgggtgaaagtgattttacttcaggagagg

SEQ ID NO: 66824 - DNA, 475 bp, Homo sapiens
agttggaagacagggtgatagtggctgcgccgccagcaaacagtctggaggtcactggccctgccccttctcaggccaagttattgattaattgacgattcgaggagggaaccccgtcttcctgcctttcttgtttacaagaagcctggtctcagcaatctcccagccctgggcactagcttttcccagctgtccctgaggagttctgtgagaaaccagccaccttccttttgcaatggggtacccagcactgttccagctggcagggacctccgatcagcgagtccaagctctctcatccaccgccaccattttacagataaggatactaaggtccagggaaggagaggattggctgaaggagcgtcagaggccttgcagtgggcttgggtgtcatttgccgcccataagagtcctgtggggtcactgccatcatccctgctccacagtgggaacaccgagaccctgcaaaggg

SEQ ID NO: 66825 - DNA, 498 bp, Homo sapiens
ttagacttgcctgttggagtccaaggatacctccaacaaaattctagacaataaaagaaagggtaagtgtctgaggggagggggcacttacaaattattccatttaatgctaattcgaggcttccagattcattttgggaaaatcaaagagcaagagctgtatgcatggctttttaaaacacaatgaaaattgggaagcatgggcttcccaattttcctgcgcataaacttctagaacaatttctattgttgatactttaaaaaaaatctttttcttttctgtgatgtggtcttttaaactcataccacaacttatggctccctctacttcctatattttaattgatcttgaggttattttcaagtcactgggcttaatgaacaaatattttagaatttcttcctttatatacactcatttctgtctcaataaaatgtctaatcaggaattcacttgtgtagaaaataaaaaatagaagtacatacccttcaagtgaa

SEQ ID NO: 66826 - DNA, 1149 bp, Homo sapiens
tgcagggaatttgttgatgcaaaaccaggaaacaatttatctccactgggaatactttgaagaagggattagagcggggctagggcagggaggatctgtaaaaaacaatatttgccaaactaaaaacacataggcacacatgggaattattttactttcaacaagttctgaaagtagtaacaaaaccagggagagttaaaagaataatttaacactgatgtttcaggaatgctaaaggagaccaggcatttagacttcatgttgctaagtgtgttcatctcaaatctaaaagccactttcataacaacaactttgctattccttagcattttgtctctttaggcagcttatttcccagtcaaagttataattttgtattcataataccataatcatttccatggtaacttcctgtgaagtcacagagaaaacactattgacttctcctgaggctctgatttcccagttgaaatcatatgttgattttattttttccaatgtaagtcaaagatttactattaaaaatcctggggatgaggtcttaacacagaaaacccatctgtcgtcgctacagaggactactatgaagaaagcgcctggcataatcttggcacatcgaaggcattcaaaaaataccagtcgtctctcttcactccctctaactctaactcattttaacctcatttaaactttgaggaaaaagaactcaaggtcagacaaggcttggttcaacaccctgagctgggttggcttgacaggactagcactagacctgacccagaggtaaaggcaattgtgggaagagcggacggacctgggaagaaatctagaagccaacgagcagaacaccaaagcttgtcactgggcaacagagaactggtccaacaaagctgtcaccatcagaaatgtgtgtcaccaggtcagagaaacaggaaatcaaggaaagacagaagagagaaaaaaagaaaagagaaagcagaaatgtgggttttgctgcaaagaaataccaaaattgtttccaatcagtcaaagtgaatcatctgtctaccaacatgcctcatttttcattgtctatagtggtgtccacagctagctgacacttcacatgaagattgaagaagaataaatttcattttaaatacatgttcc

SEQ ID NO: 66827 - DNA, 963 bp, Homo sapiens
aaaacttttcataaaatgttattttattataataaaaaatgtgtgattggttttcaatttcagattgaatcaaacatagcattctttgtaatagcaggagattaacaacatcccagaatatatctttaaaagaagtatggataaagaaaaacccgtatgcacctctgcacacattttatgtaatagtggtgatactaatttacaaagacaaagtatataggatattaaaagtgaattcttaatacctgatcttgattcttattaaatctgacttatgtgtatacaagatattattagatgaagtgtttgtccagtagcttagcttataaataacccccattctagctcattttaaacaatgtagtatgaatgatgccaaaaacaggctagaacattttcttctttccaagatcttagatttggtaaacaagctactgctcctggaactaatctaggtcatcataacccaaaatcttttgaaatatgagagtcccaattaagtctcttaggtactttttagcattttaattttaagaatgtgtttaactcttaaaacagtatattttggttgctgtttggccatttggtttatttgtaccttgttataatgaatgcaagtcagtgggtaatcattgcagcaaatatgattgctaggaatctcatgtaagtggaagtcaatataatgtatggcttaatttatccctgaactgacctaacatcacattttgttttttaataaaaactggtttaatgatatgataaatttctgtattttccacaactgttaataatgttatattttaactattgcttagtcttcattacaaattattcagctgttaaatgtgttgttcagtgtgacattatttaaaaacttaaaaaaaaatcagcttcacagaaatctttctttgatcaagagttgtctcattcccattgttattaatacagtatacaactaatgta

SEQ ID NO: 66828 - DNA, 1444 bp, Homo sapiens
aaaacttttcataaaatgttattttattataataaaaaatgtgtgattggttttcaatttcagattgaatcaaacatagcattctttgtaatagcaggagattaacaacatcccagaatatatctttaaaagaagtatggataaagaaaaacccgtatgcacctctgcacacattttatgtaatagtggtgatactaatttacaaagacaaagtatataggatattaaaagtgaattcttaatacctgatcttgattcttattaaatctgacttatgtgtatacaagatattattagatgaagtgtttgtccagtagcttagcttataaataacccccattctagctcattttaaacaatgtagtatgaatgatgccaaaaacaggctagaacattttcttctttccaagatcttagatttggtaaacaagctactgctcctggaactaatctaggtcatcataacccaaaatcttttgaaatatgagagtcccaattaagtctcttaggtactttttagcattttaattttaagaatgtgtttaactcttaaaacagtatattttggttgctgtttggccatttggtttatttgtaccttgttataatgaatgcaagtcagtgggtaatcattgcagcaaatatgattgctaggaatctcatgtaagtggaagtcaatataatgtatggcttaatttatccctgaactgacctaacatcacattttgttttttaataaaaactggtttaatgatatgataaatttctgtattttccacaactgttaataatgttatattttaactattgcttagtcttcattacaaattattcagctgttaaatgtgttgttcagtgtgacattatttaaaaacttaaaaaaaaatcagcttcacagaaatctttctttgatcaagagttgtctcattcccattgttattaatacagtatacaactaatgtaaaaaaaaaaaaaaaaacaacaaaaaaaaaaaaaaaaaaagggggggacacagaaaaaaaatatcacccccccgagggggccccaccaaatatttacggcatacaccagaaagtcttcttggtagcaagacggggccccctttataggggggcgcgattttacaaacacagggccatactcgatgccccagacatttgctttcaaaacacaactctacagtacaagtgcaaaaaaacacccgcagcgccactagtgcgaaaacacattctgtaataaagcaccaccctatccactttccgtggtgatgaaacacccaatatttgggtaaccacctagcaatcagcagcaattttcaacccccccccagcggtagtattcatcacgtctcaccacgactcatagcgcggtcacccgagacgctgaattgattcatacctcatcaaaataggccaacggcataaattattaaagttttttccag

SEQ ID NO: 66829 - DNA, 1390 bp, Homo sapiens
aaaacttttcataaaatgttattttattataataaaaaatgtgtgattggttttcaatttcagattgaatcaaacatagcattctttgtaatagcaggagattaacaacatcccagaatatatctttaaaagaagtatggataaagaaaaacccgtatgcacctctgcacacattttatgtaatagtggtgatactaatttacaaagacaaagtatataggatattaaaagtgaattcttaatacctgatcttgattcttattaaatctgacttatgtgtatacaagatattattagatgaagtgtttgtccagtagcttagcttataaataacccccattctagctcattttaaacaatgtagtatgaatgatgccaaaaacaggctagaacattttcttctttccaagatcttagatttggtaaacaagctactgctcctggaactaatctaggtcatcataacccttttaattttaagaatgtgtttaactcttaaaacagtatattttggttgctgtttggccatttggtttatttgtaccttgttataatgaatgcaagtcagtgggtaatcattgcagcaaatatgattgctaggaatctcatgtaagtggaagtcaatataatgtatggcttaatttatccctgaactgacctaacatcacattttgttttttaataaaaactggtttaatgatatgataaatttctgtattttccacaactgttaataatgttatattttaactattgcttagtcttcattacaaattattcagctgttaaatgtgttgttcagtgtgacattatttaaaaacttaaaaaaaaatcagcttcacagaaatctttctttgatcaagagttgtctcattcccattgttattaatacagtatacaactaatgtaaaaaaaaaaaaaaaaacaacaaaaaaaaaaaaaaaaaaagggggggacacagaaaaaaaatatcacccccccgagggggccccaccaaatatttacggcatacaccagaaagtcttcttggtagcaagacggggccccctttataggggggcgcgattttacaaacacagggccatactcgatgccccagacatttgctttcaaaacacaactctacagtacaagtgcaaaaaaacacccgcagcgccactagtgcgaaaacacattctgtaataaagcaccaccctatccactttccgtggtgatgaaacacccaatatttgggtaaccacctagcaatcagcagcaattttcaacccccccccagcggtagtattcatcacgtctcaccacgactcatagcgcggtcacccgagacgctgaattgattcatacctcatcaaaataggccaacggcataaattattaaagttttttccag

SEQ ID NO: 66830 - DNA, 217 bp, Homo sapiens
aaaaaaaagtaagtaactctcagaggtcaaaaatgaagaagcgggtctgatggtggtgggttatgagaactgattaacattagtgtcactaacgttggtatacaactctccactgctaagtttaactggcttaaaaaaaaatgtagaagccaaaatccagagaggaagcacctgagctgctggggtgattgaagcccggtgctctggagcctccatt

SEQ ID NO: 66831 - DNA, 299 bp, Homo sapiens
ctaatagcaaacattggaggaggtggagaaattagaaccttcatgcattgcatgagaatgtaaaatggtgcaggtgctttggaaaacaggcagttccttaaatagttaaacatagagttactgtatgatccagcagttccactactaggtctgtacccaagagcattgaaaacatatgtccacacaaaaacttgtacatgaatgttaataacagcattatttataatagtcaaaaggtgaaaacaacatgtgtctgtcaactgataaacaaatgaacaaaatttcgtatattcatacaa

SEQ ID NO: 66832 - DNA, 379 bp, Homo sapiens
cctcacactcaatgtccacagccagtcagtagtgaagtcaaataattacatctgtgaagtgttttgacaatctatgtactttaagttcatgctgccactgcttgagttctggacaacaccaactcttatctggtctaatgcaaaagcttgcctccagattttctaaactagttccttattcaaaagtctttgactaattcccatcccctaactaaccttaacaccaccacattttgggcgtcgtatgaaaacaaaagccagttttcatacaacgtccaaaatgctgaaatctcagaaaaattgaccctcatcacccaattcctatggagaaagacaggctgagcaagggttgtgttctaccataaagagtctgaaaacc

SEQ ID NO: 66833 - DNA, 497 bp, Homo sapiens
accgacttcctttatggccttttctccacttctccggactcagctcctctgtctgtaccacgtcgggggttgggaccaatcattgtatctcaaacttaagaatcaactcacatttgtactattactcatgtaacatttttttaagtcaccttttcttaaaagcaagacttagcctcctccaaagaaataatatgcatgaaatttcaactctgatatgctaggtttttccctaacattaatcacataattatcaatgtaacaaacatgcacccacataccacctgaaatcattttgtgaaccaccaggagcatgtgtatcaaactttgggaccctgagtaactgatatgacagaagatttatgcccttaggggcatcaaagatggtggttcttcacatattagagtcagcagggctgcccataacacacacaggaataatttttgtcatggtttaaggagttcataggcccctttgcagtttatctgcgaactccaaa

SEQ ID NO: 66834 - DNA, 649 bp, Homo sapiens
gatgtcaccccaaattggtagaagttgaaatcttctgatgactgggctttggtgcagtaactggtgtttgccaagtttttgctgtgtttgaaactttgaaataggtaccttacagtggactgggtgagatcttaaggatagggagtctgccctggaggagttttttcagtctgtttttgaggaaataaagacctgaaatgagttaccaaaccctgtgtcaggatgtaagatgaagcggaggcactgtcagcttgtataggtcagaaggaaaaaagcagtgaatgagactgctcgggagagggctgagagaggatactgttggtgggagaaatgacagagagtgtaaaacagtgtttcccaaactttagtcatttgcacacgtccttcatggtttttaccatgttacgtatctcctgtgctaataactacctaatatttttcttcaaattgacctgcttaaaaaaaaaaaaagaaaaggctaggtatgatagcttatcccctgtctcaaaaaaaaaaaaaaaaagaaaagagaaaaaaaactaaaacaacattttaaaagggaaacaatagcgagcccagaattaccaccgaaaatggaaatccagtgtcatcacttgatgtacgtagaaggtaactataaatagaataa

SEQ ID NO: 66835 - DNA, 813 bp, Homo sapiens
cggctagtacgaggctcgggtggtgaatcggcgaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggca

SEQ ID NO: 66836 - DNA, 300 bp, Homo sapiens
cccacgcgtcgcggacgcgtgggtcgacccacgcgtcgcagctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggca

SEQ ID NO: 66837 - DNA, 393 bp, Homo sapiens
  misc_feature (106)..(106): n is a, c, g, or t
aaaggaaaacccataggtggaaatgagaagaaaccaatgcaagaactccagtaactcaaatggcctctgtgtcatatgtccttcaaacaaccacaccagttctccnacaagagttcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaggcttccggagggataaggctcccggaggttaaggctccgggg

SEQ ID NO: 66838 - DNA, 1414 bp, Homo sapiens
cggctagtacgaggctcgggtggtgaatcggcgaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggcaaaaacaaaaaaaaaaaaaaaaaaaaaaaaaaaaaaacaaacaaagagaggggcgcgcgcgcgcgctctctaaagattattctcccccgccgaggaggcgccccaactttaacgcgcgcttcccccgcgactttttcttgtgcaacacaaaggggtggccccccccatatgcgtgcggagcagcgcgcgacattatatatacaagcccagacgagcccgcggcgcccccgcggctatttaacacacacaaggcgcaggacaacggggcgcaacaccacggggcgcaagcacggcggggaacaccccttgggggccacagagaccccccattaacacccgcgggggggggggggcaaccaaaatatggtggggccgacaccaccaatctccccctccaaccacaactgtttatgacaccgccccccacggacggaaacacactattactccaccatctcccgacaggcggtcctaaacccgggggtggtaacccaacccaccaccctcaatatatacgttgcgcccagcctgcaacaaaaaacttcgccgtaacacagcagcagctatacgtacttcgtgcgcaccactttttttatccccgg

SEQ ID NO: 66839 - DNA, 1013 bp, Homo sapiens
  misc_feature (842)..(842): n is a, c, g, or t
  misc_feature (844)..(844): n is a, c, g, or t
cggctagtacgaggctcgggtggtgaatcggcgaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggcaaaaaaaaaaaaacaacagcaacaaaaaananaacaaaagacacacaaaaaacagagaggcgcccaaaaaaccacacgggcgcaaagcgccaccacataagaagggccacaaagcgagcaaccggacgcggcaaaagcggagacacaggggaccgaacacccgcgggaaggaacacatagcaccaaatggcgtgaaccaca

SEQ ID NO: 66840 - DNA, 1170 bp, Homo sapiens
tgccagaccctctcccgggcctgtcctgccacccaggcccctccccagtctcacactgagctccagatcagggaagggccgaaaaggacgatcagggcagccgcagaaggggcgccctgcgtgggacgggtccgttgcgcgcctggtaaccgagggggaagggaaggggcctctggcgtgcggggcggtgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggtatgggctgggggacgggggggtggggggagtgttggaagaggactctagccaggggtcatatctgccacaaagcacttgggccccctgcattcaggtgaccacccctcgcctccccttctccaggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggca

SEQ ID NO: 66841 - DNA, 1172 bp, Homo sapiens
tgccagaccctctcccgggcctgtcctgccacccaggcccctccccagtctcacactgagctccagatcagggaagggccgaaaaggacgatcagggcagccgcagaaggggcgccctgcgtgggacgggtccgttgcgcgcctggtaaccgagggggaagggaaggggcctctggcgtgcggggcggtgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggtatgggctgggggacgggggggtggggggagtagtgttggaagaggactctagccagggtcatatctgccacaaagcacttgggccccctgcattcaggtgaccacccctcgcctccccttctccaggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggca

SEQ ID NO: 66842 - DNA, 497 bp, Homo sapiens
ttctagtaggatccgcgggcagtacggatgtggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggca

SEQ ID NO: 66843 - DNA, 947 bp, Homo sapiens
tgccagaccctctcccgggcctgtcctgccacccaggcccctccccagtctcacactgagctccagatcagggaagggccgaaaaggacgatcagggcagccgcagaaggggcgccctgcgtgggacgggtccgttgcgcgcctggtaaccgagggggaagggaaggggcctctggcgtgcggggcggtgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggca

SEQ ID NO: 66844 - DNA, 1044 bp, Homo sapiens
tgccagaccctctcccgggcctgtcctgccacccaggcccctccccagtctcacactgagctccagatcagggaagggccgaaaaggacgatcagggcagccgcagaaggggcgccctgcgtgggacgggtccgttgcgcgcctggtaaccgagggggaagggaaggggcctctggcgtgcggggcggtgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggca

SEQ ID NO: 66845 - DNA, 1194 bp, Homo sapiens
cggctagtacgaggctcgggtggtgaatcggcgaggaaaccgctcccgagcacggcggcggcgtcgtctcccggcagtgcagctgccgctaccgccgccctctgcccgccggcccgtctgtctacccccagcatgagcggcctgcgcgtctacagcacgtcggtcaccggctcccgcgaaatcaagtcccagcagagcgaggtgacccgaatcctggatgggaagcgcatccaataccagctagtggacatctcccaggacaacgccctgagggatgagatgcgagccttggcaggcaaccccaaggccaccccaccccagattgtcaacggggaccagtactgtggggactatgagctcttcgtggaggctgtggaacaaaacacgctgcaggagttcctgaagctggcttgagtcaagcctgtccagagttcccctgctggactccatcaccacactccccccagccttcacctggccatgaaggaccttttgaccaactccctgtcattcctaacctaaccttagagtccctcccccaatgcaggccacttctcctccctcctctctaaatgtagtcccctctcctccatctaaaggcaacattccttacccattagtctcagaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaattaaatgatgtcctgttccattggcaaaaaaaaaggacaaataaaaacaaaaaaccgtgcaagatttatcagtatatcttgttgttctctctttaaaaacagattttacacaaatgtttgggccacctagaaatttttcgccacgggagagggtaccccaattgtgtggagatctagataaaaagaggagagatttaactcaatagagcgtaatataagtacgagagagatatgaggacttcacatcactataaccaactaatcatatataattaatagctacaaaaagagggacaaaaaaaagggggggcagtaactataaattgacgcgcaaaaaaaactcgaatattatttggaagcccaaaaatagtgcgacaaaaaaaggcaaaaaacttttccccaataaa

SEQ ID NO: 66846 - DNA, 402 bp, Homo sapiens
agctgccgctaccgccgccctctgcccgccggcccgtctgtctacccccagcatgagcggcctgcgcgtctacagcacgtcggtcaccggctcccgcgaagtaagtgcgcgcccggactggcgctgggggaaagcgcagggctgtatcccggtgctttggaccctagcgcccgggacccacccccaggacgggggcggggtggggggagtgcgtcggcgaggtgctgggcacggtctcccggacccggtcccgaggccccatcctgaatgtcttcatcgggcatcctgggtcctttgcagccgcggcatgaacttcccgtgcccatcccccatcaaccccacacccattctctgcactcccactaccgggctgaccctgaccacgaccgcagcctgccctcc

SEQ ID NO: 66847 - DNA, 1074 bp, Homo sapiens
gtcactttgatacacatgtttatgccctaattaactgctagcaaatgacacctgcgaccttaagtgtagaccttaccttacataatttctggcacttttcaaagcactgttaccttctgtatctcaagggtttatcatttttaccctgtgcaggaattaggatgtggtttttcatgcctgttttacagaggaggcaagagtcacaggacatttcttgacagcagtcctgtgttgtttccatcttattgtgttatttcatcaatatttccattctgagcattattttatcatctttattgccttgtctcaaaaatactcgtataatacaaagttcttctgggaaaagaaaaaaaaaaccaacaagctacatgttagaaagcaagcctctctttcatccttccattcaattatggaagaagaaagagatgacatggaaaggagccacaggaggggagccccagctccagctctgctcctcctgctgtgtggcctctgcaaagtcactctccctctctggctttagtgcccaccacagtacaagaaggcgtggcttccaaccctgaactatcagaggaaagaaccagggcaaaggcaggcagcatgtgcaccaagctgttggactaccatactcactgtaactgagtaattacaagcggatttgcccatgaaatgaatgagccattcttaaacctcacatccctgtaagactcagaaactgcccatgtcagtgaatgccaaacaattagaagcaaataaagtgtctctatttttttcccatctcactagccattaacttccccacagtggggcaaggggccatgtggggtttcatggattgactctaccatctgcagacttcgctgaagagtcaaagttgaaacctggaagccaagacacagatacagttttttcttgtagaaagctttggccaaaatttcaaggatatttccccctacttgagactagggaagtaatatttaccaagcacctacgacgtgcccagctctgtgatagctcctttacaaactcatttaatcttcatctcatctttcaaggctaacattatcagatctt

SEQ ID NO: 66848 - DNA, 4931 bp, Homo sapiens
  misc_feature (3347)..(3347): n is a, c, g, or t
  misc_feature (3363)..(3363): n is a, c, g, or t
  misc_feature (3388)..(3388): n is a, c, g, or t
  misc_feature (4436)..(4436): n is a, c, g, or t
  misc_feature (4879)..(4879): n is a, c, g, or t
cctccctgcaagctgagggagccggctccggctctggccttggccagcccataaaggggctcccacagtgcagcggtgggctgaagggctcctcaagtgccgccaaagtgggagcccaggcagaggaggcgccaagagcaagtgagggctgtgaggactgccagcacgctgtcactatgatgtgtcatggctaggacttcccaaagctgccatggaagaataatggcttctgtcttttccatcatcctggtctacatttggccattcattggtggaatctgatgaaaattctcctggtaggtgagttgggaaaattgagttttcaggctctgtacctccatggggaaaagggaggagctttaaaaagcaggaatggcattgttttcaatgaaataactaaaaaacactggacctctctttttaccatgatttcacatctgcttgtttaaaggaaactttatgattttttatgttgattaatgttcttataaatcaagtaattacatcttggtgtggttctttatgtaattttacatattcatggagtatatacatctttgacaaatgtagcttaggcttaatgttttgacatttcactcattctaacaatttgatgcaaatactctattgaaattcttcctgctaaggtcaacaaggactagttgtcaatgcccatggctcatttaaaattcttgttacattttctttttctgtgttattattagtagtaacagttcacattcttgaaatcattgttcacttgacctttgttcagtagggttgaactttattatgagccctgtccttactcagcctccatttctattactattcctttttttgcctccattttactcctttttctttaccaacatcatgttttttcctaagtcttgttttcttctcccttacagctctataaattatctctgtctagcattactctgaatagctctatttaaatagctcacaaaaatgataattcataatctttatatatataagaataactttaatattcaatgacttctctttctgtattctctcttttggttacttcattatttattcagtgaactaaaagatcaaattcaataccacagttaaaggcacacatggaaactatgctttctttgactttttaccctggtctagaacacagcacaatgtcaaaaatgatggttaaacaaataagatatttatctaaagaaaacaaaaaacatatatcatgtaaataaatttgagaaaatgaagtggcagcaaaattgttcaaaacctcatctgttagaaactcatttcccataccagaccaactcattccaacagaagcatgtggtgtacatgataaggaatctctaagtgatcaagacagaaataaaaagcgatgcaagttagtgaatataagttttcatatgtcgatgagtgacaagtatttatttaagaagatgtactagtctcggaagtgtttacattaatgaaataaactggaaggttatcaaaagctaactgcaaaatcacaaagaagaccaatcaccttgttcgctaaggcggctgtctgagaacgtctccagattaggaagcacacaggcaccttgcttttcgaatttgcaggagccacatataagtatatttaacataggcattaggattatagacaatagcaaatctattctagtgatgtaaagtatatgttccttaatatatcattcagaactcaccctttctaccacatctaatgtggattgcgtgccttatcccacctttttattttttacattcctggagcacctggtcacaacttgaacatcagtggtatcactgactgcatggaaattacctggctacttgtatgccttcaaacagaagactgaaccatttggagggatgtgtgactatacttttttttaaatctttatatcacttcacatggctcttattagttgttcaatagttgctgaatattgacactcgtatgagtgagaagtcctgacaatgactgcaataaactcaagtcacccttgaaatagacagaaatgcttgagagatgccactcagtgaatcaatttgataagcaagatgtaggatttgtagaacagtaaaggaaatggaatccagatttggggtgttgatggggagattctgaacaattggtaagtatgtatattaaatgaaagattttcaaatttctaaatgagctttttaaaagtacaatttacatacaaagaaaattcacttttaatgtagttctgtgagtacagatatatgtatatagtagtgtaaccatcaccataatgaaaatttaaagtggttctaacccccaaattcctgcatgtctgttgtagacaactcctccctcacactctcaatctttgttagccactgctatgttttctatctctatactcttaccttttccatgatgtcatagaaatataatcttactagactctcagattgtctactttcacttaacataataaatttgagattcttgcacgtatgagtttttttttttcctttttgagtattattgcctcatttaaagacattgtagtttgtttattagctcaccatttaaacatttcggttgattctagtttggagtaattattttaaaaatcaactggaaccattcaaatacaggtaggttttgtgagaatgtaagtttttatttcacttgtgtaaatactagactaaaattgtgatgccacttagtgtttaactttctataaaattgccaaactgttttctaaagtggggtgccgttttttttctttgtaggatctatgagaattccagttgctccacttgtagacactaagtattgtcaatttttaaagctattctaccaagtgcataattatatcttattgtggttttatttgcacttatctgataactaataatattacatattaccatgtacacattttccattcacatatatatctatgaatggaaaatatatttatatttcataatatatatttcattatatatatattccataaattgtcttcaaaagttttgcctattattacacttggttattttatggaggtaaagtgggattttcttgaggtaaagttaatataacataaaattgataattttaatgtgcacaaaagcatttagaacatatacaatgttatgtaactgtcacctctatatagtaccaaaacattttcatcaccccaaagaaaattctgcattgattaagcagttaccctgaattccaatctctgccccagctgctggcaaacatcaatctgtctgtctctaaagatgtacctattctggatatttcaaataagtcatatctcagatcacatacaatatgtgatctnactggctggcttcctncactaagcaagatgtttttgaggtncacccatattgcattatctattaatacttcatttattttttatggctgaataaaattccattaagattatatattgcaatttgtttttccattcatctgctgatggacagctgtgtcatttctatcttttggctattgtgaatatcgcactgtaaactgtgaacatacgtatacaagtatttgagtacctgtttttaatttttgggtatgtatctagaagtggaattactgggttaattgttaattctaattaattttttatgtagccaccaaattgttttctatactggctaaacaattttatgtatttctatatattttcaccattgccgatttcattttaaaaagaattatatccatcttagtagatgtgaagtagtacctcattgtggattaaatttatgttttcccagtgagaccaatgggattgagaattatctcctatgttttttgtctatttctctattttctttgaagagatgtctattcaagttctttgcccatttttcagttgggctatttgtatttttgttgttcagttgcaagagttatttatatattctggataacacatattcagataggtgatttgcaaatgttttttctcattgtgtttgtgatttactttttttttacaatgtattttgatgcacacattttttattttgaagtcaaatttatctgtttttaaaaatttcattgccaatgcttttgatattacatttatgttattgacccattttgaaatcagaaaatataagtcttccaaatttattatttttttaaagattgtttttgctactcaggaccacttgcaattcattatgaatttaagaataggcttttccattttttcaaaataaaaggctattgatattttgatagagattgctttcagtctgcagattccttaggaagtattgatatgtaaatagtaatgtcttcctatccggaacactggatttatttccatttattaaggtcttccttaagcaatgctttcttgtatttattgcacagattttacctttttggaccaacttatttntaagtataagattctattggaacctactgtaaataaaattgtttctttttttttttttttttcttttgatggagtcttgccccgtcgcccaggctggagtgcagtagtgtgatcttagctcactgcaacctcccgatcccaggttcaagtgattctcctgcctcagactcccaggtagctaggattacaggtgtgtgccaccatgccaggctaatttttgtatttctagtagagacagagtttcaccatgttaggcaggctggtcttgaactcctgaccttaggtgatccatccacctgggccccccaaagtgctgggattacaggcgtgagccaccgcacccggcctgcttattcattttcttttgggggtatttgctggtaatttaaaggaaaacaactcattttttgtgcattgatcttgtatcctggactgttaattcntttactattattaaataacaaattattaataataaattaattatcaattgtg

SEQ ID NO: 66849 - DNA, 875 bp, Homo sapiens
tagggtctgagggaggaaaaaagaagaataagagtcaaggatgattcagaagtttctagctttggggcagctggttggattgctcattccacttactcaaattcaaaaaatattgagtactgaactgtatgcttaacaatggttaaattagtaaatttaatgttaggtgttttctactacaatttaaaaaatatttattgagcactcagtgtgccaagcaatggaaataatagacactggatataatagacacagtttctaactttctggagatactacaaagtgaacccacaaataatatacataaaaatcatggtaaatgcatcggaggaaaagaacagggtactataaatacaatgatattagatctgttaagagataataaggagacaacagtaagggagaagaattccaggcaacatgtgtgaagtccttgaagcaagtaataacttgtcgtgtttaaagaatcgaaaaaaggctatgtaactggaaaggagtgagcaaggggacagtgatgttatacaagtcagagaacgtaggcactgcctgggatgtaaaggatcttacggaccattgtaacaattttggcattaaatcatgcgtggtggaaagccagttaagttagtgtatgtatgtatttgttgagggaaaggcaacgtgatttgtaacttcgtattctaccgtacattttattttaacaaatgaactgtccctacttttatctaaggactcacacatcaatttgtgtattaaatccatctctgtggtctactcagggctttgatcctgattttacctctctgcttcttgcatcagtgtcttattctgtacctgaccacttcagttaggttacagatataatatagcccatcttt

SEQ ID NO: 66850 - DNA, 335 bp, Homo sapiens
cctgacttcaacggatccactcgccttggtctcccaatgtgctgggattacaggcgtgagtcaccatgcctggctcagaggctgttaataaacaagggaagaagtcactctttaaggctcaaatctcctctgttccccaggcagcctgacattttcagaatgggctcattaaccaacttgcctaatgtggagctctatgtaaccacacaacacggaccccactcatcaaggctgaccacttggcacccagtgaatctcaaccccggaaatgacagccttaggtcccatgggaaatggccccaaaggggactcagctccatatcagaggctgggag

SEQ ID NO: 66851 - DNA, 1163 bp, Homo sapiens
tattcgtccccaagcttcctaattttaagctacaacatttcctaacccttaagttttcacgccctaacttggttgcctttccaaagtccatgtttgttgaatatgatatggtaaaaaccaatatctatttggagacagtggaggggatggtagtaattgagagacagtgtcagatggagcagtgactttacaatttttttgactgcaatccacaattagacatttcacattgctcccccatgacaacatccctatcgacccctgcccaaaaacaagttatttaccaatcttgctataagcaatgatgactgattttttcttttttctactttatttaaaaagaaaattatagtctcaactctttatattaattttacacacattaattctacagattgttttagcacttagaactaaaagtgttcaagatttgattttgttaccttctctgtgtaagctaaagttgctgacttttctgagtttccattttattgattaaaactgggatagtaatagtattttacaccattttataactttattagaatgacataatctgagtgaagtggttgtgccaggcacttactaaacacacagtcaatgagtatgttctctccgaagtttgttagcttagggaattgggaggatgccactgataataatggtgactcttattcagaggaaaactaattcagttttagacatgctagagtttgaggtagccaaaagagtttagtcatatcacttggaagcaaaccaatgtgaaatagtttcaaataagcaaattttaaaaaatgttaaatgcaaagcaaacagtattaaagctttggggacttaatgattgagtctccttacacctacacaagattggctaaatacacatacaactgtgtcactctaccagatttctgttaacattctccagaatttaaactgcagaatcagtcatttgtatgactgtttgtctctattagcagaggtaatgacatgtatcagtgataggtaattgtggaaaaaaaaacagcacttggaattaaacctagagttggtgattcttacagggtaacccaacggctaccttaatttctatgattcagtttcttcatctacaaaatattatttcacaaagttgcagttgtcaaagggacaagtaaatatgggat

SEQ ID NO: 66852 - DNA, 497 bp, Homo sapiens
catctgtgtctttagaagtagtgtcacctctagtaaaagagggccagtagaattgagtggtggcagcctgtgatgtatatgaattttggctgtacgtctctagcgactattttctccaactctatttagtaaaattctacctaatttcagctattgtgcttccaaagtccatgtttgttgaatatgatatggtaaaaaccaatatctatttggagacagtggaggggatggtagtaattgagagacagtgtcagatggagcagtgactttacaatttttttgactgcaatccacaattagacatttcacattgctcccccatgacaacatccctatcgacccctgcccaaaaacaagttatttaccaatcttgctataagcaatgatgactgattttttcttttttctactttatttaaaaagaaaattatagtctcaactctttatattaattttacacacattaattctacagattgttttagcacttagaacta

SEQ ID NO: 66853 - DNA, 2267 bp, Homo sapiens
attagaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgctcaaatagtacatcgaacaggtgcagtttctggacattccttgaagcaatgtggtcatcaaataagtgagtgcttgccatcgagacatttataaaggagttgatatgagaggagtcaattttaatgtgtctaaggttagcagtgttgaagaatgccaaaaaaggtgcaccaataacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaacggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaagacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcacgaaaaaaaag

SEQ ID NO: 66854 - DNA, 1757 bp, Homo sapiens
caggagtttacaatttagtttttatttggacccaggttgctcttgatttacatttaatctctgcaatttattagagtcctgtagttggatttactttgaagagagtttcccagaagaataaaatttgctgcgttgctttttgggtgtgagctgcttttgtatttgcctaatgcctttaatgcaaatttctttctttctctcttgcttttttttaaaaaaaatagaaatgtttgtcttcttaaaacatctgaaagtggcacaccaagttcctctactcctcaagaaaacaccatatctggatatagccttttaacctgcaaaagaactttacctggtaatgtgatttgataataatattacataaaatgtaacctatttcatgacttttaacagcaacagtgatgaaacaatcctcaaggtaacagaaacttgtgtaaatgtcgttcattgcttttcccatctgatatctttttgtgtttataattgacacagaaccctgccattctaaaagagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaacggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaagacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcacgaaaaaaaag

SEQ ID NO: 66855 - DNA, 711 bp, Homo sapiens
gtattcaaagataaggtccttatgaaaaatacactgctctgattcactttaaaacttatttccatatttattatttattgtgggaataacaatattcccaatattattatttattatttaagttattattattaacttccctctgaggttatatattggttactcacaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaaggtaactcatgagattatgaaaaacacaataggctgcttgagaaaattcatttcaaaatatattttccaatagcataatttaatcatagttttttaaaaaattcagagacaaatgatctgataaattgataagcaacttttaacaaattgaatatacataatatatatttatattatttatgatatatgtcacaatctatgcatgtgctatttaagaggggcaaatatacatgcaataattgtgctagaatataaaaacattagacttctttgtcattgggatgatgatatcaagatttctttgttagatttatttcagatagaaaaggggatacgaaaaatgcaggcacatgagatacttggagaactttaagaaagagtgagtgtgtgtgtgtgtgtgtgt

SEQ ID NO: 66856 - DNA, 612 bp, Homo sapiens
gggatctgtggtgaagttaggttctatcttaactgtccctcctccatgcaagagggcatctctctccatactgtgctgcccaggcttgaaggtgagatgacaccggtaatgtgaaattgtccttcctatacacttctatgtgtcttttcttatttctgtgctgcaaccaggtggtataacctctcacctgattccttagctctagtgaagttattttcgtgcatggatacttgttcgaattgatgtttctgcaagggatgagcgctagaaactcctgttctgacaaactcctattcctattcttgctgacatcactccctgaaatagttaatatacttaacagctgaacacggataggatgttcatggaatatgttgacaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcaggtagcaaatttttattattctgattgtttccaaataaactataatttttaagtataattttttactttatgagaaaattaatc

SEQ ID NO: 66857 - DNA, 2364 bp, Homo sapiens
attagaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgctcaaataagtgcttgccatcgagacatttataaaggagttgatatgagaggagtcaattttaatgtgtctaaggttagcagtgttgaagaatgccaaaaaaggtgcaccaataacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctggtaatgtgatttgataataatattacataaaatgtaacctatttcatgacttttaacagcaacagtgatgaaacaatcctcaaggtaacagaaacttgtgtaaatgtcgttcattgcttttcccatctgatatctttttgtgtttataattgacacagaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaacggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaagacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcacgaaaaaaaag

SEQ ID NO: 66858 - DNA, 1460 bp, Homo sapiens
ccctcccctgcctgcattcccgggacggacccgagggaagaagcctcaggaggagggtgtgggccgaggcgcggcggcggctggagcagcgcggtagggtccttcgccagagcatccggtccgagggcgcacacaggcagaaggctcggggctcgtccactctcctccctctctcctcctctccctggcttttgtgttggtgcctccgagctgcaaggagggtgcgctggaggaggaggaggggggcccggagtgagaggcacccccttcacgcgcgcgcgcgcacacggtgccggcgcacgcacacacgggcggacacacacacacgcgcgcacacacacacgcacagagctcgctcgcctcgagcgcacgaacgtggacgttctctttgtgtggagccctcaaggggggttggggccccggttcggtccgggggagatggcgcagcccatcctgggccatgggagcctgcagcccgcctcggccgctggcctggcgtccctggagctcgactcgtcgctggaccagtacgtgcagattcgcatcttcaaaataatcgtgattggggactccaacgtgggcaagacctgcctgaccttccgcttctgcgggggtaccttcccagacaagactgaagccaccatcggcgtggacttcagggagaagaccgtggaaatcgagggcgagaagatcaaggttcaggtgtgggacacagcaggtcaggaacgtttccgcaaaagcatggtcgagcattactaccgcaacgtacatgccgtggtcttcgtctatgacgtcaccaagatgacatctttcaccaacctcaaaatgtggatccaagaatgcaatgggcatgctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgccgattgaaggcccagaaatccctgctgtatcgtgatgctgagaggcagcaggggaaggtgcagaaactggagttcccacaggaagctaacagtaaaacttcctgtccttgttgaaaccaaacgatataaatacaagataaattatcactggagttttttctttcccttttttctgtgcctgcataatgctgacacctgcttgtttccatacaaattgatatcaaaataaaatttgtatagattatcacatggctttttgtcttgctttcctccaagacattcctgattgtgatgagcagaacaggcagtttgccctactagagtgatattctccatgccagtggcacactccctaccagctttctaggctctctgaaattctcatcgtttgagtcacttcttcaggactaattcattctctc

SEQ ID NO: 66859 - DNA, 1282 bp, Homo sapiens
ccctcccctgcctgcattcccgggacggacccgagggaagaagcctcaggaggagggtgtgggccgaggcgcggcggcggctggagcagcgcggtagggtccttcgccagagcatccggtccgagggcgcacacaggcagaaggctcggggctcgtccactctcctccctctctcctcctctccctggcttttgtgttggtgcctccgagctgcaaggagggtgcgctggaggaggaggaggggggcccggagtgagaggcacccccttcacgcgcgcgcgcgcacacggtgccggcgcacgcacacacgggcggacacacacacacgcgcgcacacacacacgcacagagctcgctcgcctcgagcgcacgaacgtggacgttctctttgtgtggagccctcaaggggggttggggccccggttcggtccgggggagatggcgcagcccatcctgggccatgggagcctgcagcccgcctcggccgctggcctggcgtccctggagctcgactcgtcgctggaccagtacgtgcagattcgcatcttcaaaataatcgtgattggggactccaacgtgggcaagacctgcctgaccttccgcttctgcgggggtaccttcccagacaagactgaagccaccatcggcgtggacttcagggagaagaccgtggaaatcgagggcgagaagatcaaggttcaggtgtgggacacagcaggtcaggaacgtttccgcaaaagcatggtcgagcattactaccgcaacgtacatgccgtggtcttcgtctatgacgtcaccaagatgacatctttcaccaacctcaaaatgtggatccaagaatgcaatgggcatgctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgccgattgaaggcccagaaatccctgctgtatcgtgatgctgagaggcagcaggggaaggtgcagaaactggagttcccacaggaagctaacagtaaaacttcctgtccttgttgaaaccaaacgatataaatacaagataaattatcactggagttttttctttcccttttttctgtgcctgcataatgctgacacctgcttgtttccatacaaattgatatcaaaataaaatttgtatagatta

SEQ ID NO: 66860 - DNA, 455 bp, Homo sapiens
ggggtagaggggacggggtagcggggaccgggaaggcgcggctcagctgcccgctgctcccgaggtgaaagaggtgcctccgcccccaccccatccccgcagagttgcgttgctccagggaggccgaagtgatccagtgatgtcttaaggtgcagctctttgtcctccccagctgtgctccctgcccgctgaccccgtgcgctcgagccagtgggggtggggagcccgaaacctataacataaacgggggcaaggagaaagaagtctatcccggggtggcgtgtgccgctgtccccaccccgtctctttcctcctgaggcttcttccctcgggtccgtcccgggaatgcagtcaggaggagggtgtgggccgaggcgcggcggcggctggagcagcgcggtagggtccttcgccagagcatccggtccgagggcgcacacaggcagaaggctcgg

SEQ ID NO: 66861 - DNA, 435 bp, Homo sapiens
cacttcatttttatagtgctacagaaccatgttttctcctctctgttcatgttcccttttctgactccacctttgggtttttgtatcttccaggttcaggtgtgggacacagcaggtcaggaacgtttccgcaaaagcatggtcgagcattactaccgcaacgtacatgccgtggtcttcgtctatgacgtcaccaagatgacatctttcaccaacctcaaaatgtggatccaagaatgcaatgggcatgctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgc

SEQ ID NO: 66862 - DNA, 738 bp, Homo sapiens
aaaacagttatacatgtctcctcccagcaccatgaaagcccctacaaaacttcagaagatcaccggctttcaattgtcttcgagctggacagcagctcaggagggctggctgcctggaggggatgatgccgacacaggaggcgctgctggctgttcaggtgtgggacacagcaggtcaggaacgtttccgcaaaagcatggtcgagcattactaccgcaacgtacatgccgtggtcttcgtctatgacgtcaccaagatgacatctttcaccaacctcaaaatgtggatccaagaatgcaatgggcatgctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgccgattgaaggcccagaaatccctgctgtatcgtgatgctgagaggcagcaggggaaggtgcagaaactggagttcccacaggaagctaacagtaaaacttcctgtccttgttgaaaccaaacgatataaatacaagataaattatcactggagttttttctttcccttttttctgtgcctgcataatgctgacacctgcttgtttccatacaaattgatatcaaaataaaatttgtatagatta

SEQ ID NO: 66863 - DNA, 985 bp, Homo sapiens
ggtcgcttcgatatttagatgctcgaacgttagactgtacttcttgtgtgttggatgccgcgtcatagggggtggtttgcgtgcccacgtattgcggatcctgcgaggtgagaatgagcgcatccctcattcactgggacatagggatcctgactatgcactcaggcatcgtgacctggtgaggctcgtaggctgtccctgtaagtctcgtagttcgttctactggaacagtacgtgcagattcgcatcttcaaaataatcgtgattggggactccaacgtgggcaagacctgcctgaccttccgcttctgcgggggtaccttcccagacaagactgaagccaccatcggcgtggacttcagggagaagaccgtggaaatcgagggcgagaagatcaaggttcaggtgtgggacacagcaggtcaggaacgtttccgcaaaagcatggtcgagcattactaccgcaacgtacatgccgtggtcttcgtctatgacgtcaccaagatgacatctttcaccaacctcaaaatgtggatccaagaatgcaatgggcatgctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgccgattgaaggcccagaaatccctgctgtatcgtgatgctgagaggcagcaggggaaggtgcagaaactggagttcccacaggaagctaacagtaaaacttcctgtccttgttgaaaccaaacgatataaatacaagataaattatcactggagttttttctttcccttttttctgtgcctgcataatgctgacacctgcttgtttccatacaaattgatatcaaaataaaatttgtatagatta

SEQ ID NO: 66864 - DNA, 410 bp, Homo sapiens
ctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgccgattgaaggcccagaaatccctgctgtatcgtgatgctgagaggcagcaggggaaggtgcagaaactggagttcccacaggaagctaacagtaaaacttcctgtccttgttgaaaccaaacgatataaatacaagataaattatcactggagttttttctttcccttttttctgtgcctgcataatgctgacacctgcttgtttccatacaaattgatatcaaa

SEQ ID NO: 66865 - DNA, 153 bp, Homo sapiens
aatgaacatggtaatgagaaaaatttacacacaagtgattttgaaaacagaatggattgcttacaaattacaggaaatgttataacacaaaccagaagaattcaatggaaggcaataagggattctgaaatgaaaattataaaagtatcaaga

SEQ ID NO: 66866 - DNA, 335 bp, Homo sapiens
aagtccagatgcaaagcaaagagagacttttagatgattgtaaagtcatttaatttccagacattgtctagtgtttaaacactgacatcaaagcaaagagccaattatcagagttcatttggtctgaagccccattgcctgaattgctatagttttccttaggctgaaaaggaaatgtgtgtcacatcttgaagatgtagtatataagatcactttatctagagcagtttaacttgaaatgtgtgtttgggctcactaaccacaaggaggcattgaagcatctcttcaaaatgtgaaaagcaattttaatgaagaaaaaaaaagttacacctaca

SEQ ID NO: 66867 - DNA, 343 bp, Homo sapiens
atcatctctttgtgcaggtatccacactgcctctgctacctgcccgttggtcactcactcattgttctgatgataagatcgacagatcacaagaagggacaaggctcatcccaggaggatccatgatgctttatgaagacagtcccaacagcccatctctgtcatcctccagacgtgccaaggctgaatcatggagcaaacacagcacaggctcaagctgagaccctgccatgtgacctcctagttctatgaaatacccttcaacaatgcagaattgacaaaccctcccagaacctgatatagatacacatatttattatataagtgtctcagtaaagaaaca

SEQ ID NO: 66868 - DNA, 391 bp, Homo sapiens
catcaggcttacttccttgctcagctcctggttccctctgcaggacggctctttctcctattttctgctaggctaactcctattcttctcagcttcctccaggatgtccctgactcccaagccttgatcaggtgcccttttcattggcccgctcccttatccaccctgaatttatcccatggccagcgtactgacatgacctagtcactggccttcgtccctcccacactgtagtattgattaggatttttgggtttagtatataccaggcacggagcttagtgctttgtttattatctcactgaggtctcataatgatcctatgaaataagtattagtactgatgaggaaactgaagctcagaaagggtgaatgatttgcccagggttat

SEQ ID NO: 66869 - DNA, 2344 bp, Homo sapiens
  misc_feature (18)..(18): n is a, c, g, or t
  misc_feature (161)..(161): n is a, c, g, or t
  misc_feature (489)..(489): n is a, c, g, or t
  misc_feature (790)..(790): n is a, c, g, or t
  misc_feature (943)..(943): n is a, c, g, or t
  misc_feature (1080)..(1080): n is a, c, g, or t
  misc_feature (1154)..(1154): n is a, c, g, or t
  misc_feature (2143)..(2143): n is a, c, g, or t
agttttcggagttaatantaactagtgatttggggctacatttaagtgctttaagctatcctacaagcttaaagtagtatacatgcaaatacttaaatgaattaggtacaagaatacagaggtaagaaatagaatctattgtagaataaatcctatttcanatgtgactgttttaggatttgaatcaaccacatattacagaaaaccccaagataaagccttggcataaccaagacaaagtttatttttttctctcacataaaattagtccagacttattttaccagtggtatggcaactccacagtcaaagggacccaagctcatctgaccttcgattcccttatcctgggacaggcttacattctcaaggtcgactcctggcctaatggggctactggagcttcagccatcacactctgtgcttcctgttatatctactggtcagaacttcagatacatctgtctaaaaggaacgctgaaaatacantctttaagctgtgcaattgtacctggaataaatgagttcttttaataaaaagagttgaatggatatttggtgggcaaatagcagtccatgctacaataataaacttcacaattttagaattagatatcttgtaatgaatattctgacgtggtgtcaacttataccatagatagattataactttgaaaaggaattagaacacaataataataaattcacactaaggctcttttggggaaaaaaaatctctaccatttattgagtgtttattatcttcacaacatccctatgagttagggantatttttgtggacattttacagataaagaaacagaggcattgagatgataactagcttgactaaggagtggcggagctctgggcagtgtggttcctgtgtgcccataaggccattgcacaatgctgcttcatcatgtaattcagaaagtattncaggatgtggcagttggtcatcatgaatgttcattgttatcttgtggctttgtgaaaaattctggtcattcaaacgatttgactgttgagattctgtgcacatgagattgtactgtgtacatgtttctaaaaatgtntgttatagatcaaaatgcacacactcatttacctctaagaacagttcttatattgaagggaaattatctgtacntgagagaacaacgtggttttgagtacaagtggtgaacagacattgaatagttgttttcagaaagcatcactcccctgtacctcagaacccagcctcagtgctggttgcgagccaacagctttgatgtcctgaagtttttgcatcacttctcttttgcccctctttgggattcaaagatgataagtttgaagtggagttctaccgcttccattggaagagaaaaagtttccgtgtgtgtgtgtgtgtgtgtgcgtgtgtgtgtttacggagaggagttctatgcatctgcagagggtgctgccatcaacaaggagaacagagtgggatgaagggtttgggaagccaggatgggcatctctgacgagctccagaactctccacctaagtgtgcaagtgtaaacactccctgatgtgtgaactggccatctcaagactaagtatttagcaggaaatgccccctattcaacccttgccttctcaggtgtagaggttgggttgtctcttccatctttgtttgaattatgtcattaatcaaccttagtgaaagatcacttagtcatttgtgacagcataagttcttaattgttaggaatcactggtgcggcacacatctttttctatccatgaacaacgtcaaatgcttattttctcatgagcttttattttttccttttaaaaaaagtttcttaggataaacacagcctttttccttgtctctcccttgccctctcatctttttctcaatctttatattcctatatgtcactgaagagtccccgtgccaacgctgtgcagtgggaggctcctacctccaccagcttttgaggaggttgtagtcctgcaaccttagaggttccacagccaagctgggggtctttctggagcatgggtggtgaatctgagatctatgcacccaggaagcctgacacattattgtggtgtctcaattcttttttttttaattagaaaaattgtatcaaattgcattnggtgagagcaaaaataaactgaagttggttgagctttggaagactacaagccactgtaatatttaagatttcttgacctccagaactaacatttgtcctgtcagagaaaataattactcctgttgagaatacatgcattaaagtaagatgttcactactctatatgatcaccaaacattaaataatatgttttacacatgt

SEQ ID NO: 66870 - DNA, 243 bp, Homo sapiens
aaaaatcttccctgccagcccacctccaagaagtcacttccaccgatcatgccgctgggcacaggtgttgcccaccaatcatccaaatgagcgagcgcctttcaagcctatggggagaagctgctggtcttcatggccttcccctccttggcatagcttccatgcccagcaagccaggagggatgggagcagccctgggccagaatgccacagactcccgctgttcttactcaaaatccagcc

SEQ ID NO: 66871 - DNA, 380 bp, Homo sapiens
ttatactctatatatcccagcagtggtatgttaattctaggccaagaatgtttaaaaacaatattgtaaagtccaattataagaaaagccttccctgcctcatgagttatacatattagatggtttttaacttcagatatctttttaaaagcagtgaaccgaaagtaccggtaaatgggagaaatgagaatgcattttctatacaggtgagaaaagatgcctcatcatacttgacttttgaataccctccctaaaattttaatatctgctctataaaaaccatacactgtaaagtcacaggtgataaactcatcactaaatgtaattatctttatttttcccaacctctatgacacttggaattggaaacaaatttaaaa

SEQ ID NO: 66872 - DNA, 526 bp, Homo sapiens
agctaattaagcaaactgaaatgcagtgccaaagttacaaagagctttagggttaaagaatggttatttgacagtcatgagaggcttttactaatctccgagacttcatgactatataggatggtgtctgaacattttaaatgaatgttggtgaaataagcagagattcactatgaaaccccttatcagctaaaatacagtaaatgtgtctgtattagtctgggcaccttggcagtgtgagaaatgagaccagttgatgtggatgagtctggttagatgggccaggctatttcagtattttgaaactgcaactgaagagtttcatttaaacagtttctctccatcagactataggagtggtccaataattgacatttatatgtttgcacagccataaaccaaggtccatagcctatgtcatgccccagcatcagcatcttttaaattttatctctggtaagagttgacatttcaaaagaccaacatatgcgataaaaatgagaatatgggagtcatctatggtttt

SEQ ID NO: 66873 - DNA, 182 bp, Homo sapiens
tttgtttcccatcaagtccctttcttctagcaaccaagcgcccctgcagcctgcccctgacacagcctggcagcaggtgcttaccctccaagggaaacagccaggccctgtgccccatatgcaatgaacaaggctgggctgtgcccctttcctgcaagcaatcagcacaggccctcaagcat

SEQ ID NO: 66874 - DNA, 219 bp, Homo sapiens
tagacaaaataaatggacatttctttacaatgaaatactgtcacagcacaaatttttaagtattaactgaaaaatgtaaagattacacccaaggctcatacaagaaaggaccgttagatttggggtcaaatgtttgaaattgtctgtcttacaatgaaactgccaacttaattggttttttaataataaacactattttatgtgtgctgtagatcctat

SEQ ID NO: 66875 - DNA, 1785 bp, Homo sapiens
  misc_feature (212)..(212): n is a, c, g, or t
  misc_feature (511)..(511): n is a, c, g, or t
  misc_feature (621)..(622): n is a, c, g, or t
  misc_feature (894)..(894): n is a, c, g, or t
  misc_feature (1231)..(1231): n is a, c, g, or t
  misc_feature (1247)..(1247): n is a, c, g, or t
  misc_feature (1417)..(1417): n is a, c, g, or t
  misc_feature (1598)..(1598): n is a, c, g, or t
gggacatccagtagtaatgactagtaagtagtttgggagaagctgagccttgaaggaagtctgtgggtcaccagattttaggtggaattgaagtcctggatttgcagtctctgggaattacatatagagtgagaagggcagaggactgaggaaggaaccctaggtaacaaatgttgggtagggatagaagagcagtctgcaaaaaagacttnggaccaaacacttcagaggcagctggtaaagaggatggtgtttctgaagttatagccaggcagtcttctctgacttctctgtctgcctcttctctctgccaactcccaaccaaatcagcctttgagtatagttgtctctgcctccataccttagttcagaactacctcattttttgctaggactccattaatagcctattgtcttgtctctttactcctaaacttactcttgtcagtcattcttccacacttttccatagcactctttctaaagtacctaaactgtgccagtggttccncatcttcagaatagtctgaccttctcagcttggcataagatgcctttcatgatctggcctccactgtttgttttcaccttttgcttcctttccccttcacatcctaaatnncatgcattcaaattatttgtccttcctagaaggatgcttctttgcttctgggtctctgtatgtgcttttttcatgtgttcttacttcctggaatgacagactctccatggttcattaactgtacaagatttgactaaagcgttaccttttctgcaaagacttctgacttccaagtaaaaccaggctcttccctctgggctgacttcctgatttgttgcatatctctggtgtagttgtaatgacaatatcttgaaactgtttcgtatttgttntccccttccaatttatgagctcttagaggacaacaattttgatataaggatcttcatattcttagtgtttggcttagtttaataaatgtttaatgcagtggttttctttttttttttttaatttgctgttaaaattttttttacacatttaaaaactataaatagagatgggatctcacttgatcacccaggctcttgaactcctgggctcaagtgatccacctgcctcggctcccaaagttctgggtttgcaggcatgagccaccacatccagccatggaatggttttcaatgtggcttctgtaccagcagtatcagcatctctggaaacttgttngaaatgcagattcttnggccccactcaatatttactggattagaaactaagggggtgggtcccagtaatctgtgttttaacaaacttctcaggtgattctgataccttataacaaatcctgcaggtgattctgatagttctaatagttagaaaattattaattcgtccagtgaaacgaatgattgncaacattcacagagaggaataaactctgatcttatgataagtggaggagaaccctgttcagtctttagaaaaaggaaacaaccatgctgtagtgatggctgcaagaaattaaaatagtgagcctatatagttagattgacagttttgtttttttgtttgtttgttttgagacggagtttcnctcttgcactccagcctgagcgacaagagcgaaactctctctcaaaaaaaaaaaaaaaatccaatcctggctgggcgcagtggttcatgcctgtcatcacaacactttggaaggccaaggttagaggattgcttgagcccagaagttcaagaccagcctacgcaacatggcaagaaactttctctac

SEQ ID NO: 66876 - DNA, 401 bp, Homo sapiens
ttgaagtagatttattctacaaggtttatgcatctgccctcccatatggcccccatgtcatctgtggatctcagttcctgtttggaacacctgatccaaccattcttatctagagttgggcaactatctcagaaaggcaatatttttttgaaactgcaaaccaaagtttccattcagactccccaagggattttactgacaattttaagcactgaagatttctgggagggaaggagagctgaagtctctttgagatgcacaatacctgtccccagttgagaggagaaatgcaagtatcaatacatgcagctatgaagcatcaatcagaaaacaacaaatgggtgttacagtaaatgcacatgaggcagtctcaataaaaagggaactgtgtctctgataag

SEQ ID NO: 66877 - DNA, 270 bp, Homo sapiens
cctttacttgtagtcttaggtgattttctaaaccattatttcctaggattacgtatgcccttttatttttgcttcagttttgtttttgtttttggttgttgttgttttgttgtttttagagatagtgtcttgctatattgcctggggctggagtgcggtggtgagatcatagctcactgcagccccaatctcctgagctcaagttatcctcacgcctcagcctcctgagtagctgggactacaggtgcatgccaccatgtccagctattt

SEQ ID NO: 66878 - DNA, 578 bp, Homo sapiens
cgagacttggagctgaggtcatttggagctgtttaatactgaagagctgttgagcactggaaagtgctgtgtaaccctggaaaagaaccgtgtaacgctgcagaagtgtgtggtagctatgccggaggtgtcatctaaaggtgctaccatttccaagaagggctttaagaaagctgtcgttaagacccagaaaaaggaaggcaaaaagcgcaagaggacccgtaaggagagttattctatttacatctacaaagtgctaaagcaggtccatccggacactggcatctcttcgaaagctatgagcattatgaattccttcgtcactgatatctttgagcgtatagcgagcgaggcatcacgtttggctcactacagcaagcgctccaccatttcttccagagagattcagacagcagtgcgcttgctactgccgggagagctggctaaacatgctgtgtctgagggcaccaaggctgtcactaagtacaccagctccaagtaagcctgctaagtaaacgtcatttctaacccaaaggctcttttcagagccacttaaacatactgaaacagctgtgggc

SEQ ID NO: 66879 - DNA, 1103 bp, Homo sapiens
cgcgctattcattcagagaggttctgcagttccccgtgggcggtgtcaacgggctgctcagcaagggcaacgatgccgagagggtcgggggctgcacgctagcgtacctgccggcggttctggagtacctggcctccgacaccctggagttggcgggcaacgccgtcggaacaagaagaagacccgcatcatcccgcgccacctgcagctggccatccgcaacgacaaggagctcgacaagctgctggcccgagtgacaatggcttagggtgacgttttgcccaacatccaagctgtgctgctgtcccaaaggattgggagccactaccacaaagtccagtatgaataaccacccaagttgtaaaagccagcgaagtgacttgaatgtctaatgtctagaagaaacaaaaacaaaaacaaaaacaaaaaccccaaagctgaaatcaaaggcccttttcagagccactcaatttctgagaaagagctagtttacaaaaggattacaaaatgctgtttcgtcaataagactacagctttcgtaaacaggactcagaacagttctggttattggggtatccgaagcagtttcctttaatactcggtagtattgacagcagaacttgatgtttctgggtggaactgtttcagcacctacttcaggcttttgcatttctgatgactggatggccccactggatccatgactcttgactcaactggtcctatggccactactcagaagtggactcagcttcaggaaggccattttccctatccctatgattgctttctcaaccaatcagcagcacccattccctagccccctgcttgccaaactatctttgaaaaaccctagcctccaaattttcggggaggttagtttgagtagtaataaaactctagtctcccttctagcctgttttacatgtattaaactgtttctctattgcaatttccttatattgataaattggctttatctgggcagcaggcaaaagaaacccattgggtggttacaactgctattacaaccagtaatatatgaccatcatatggcacccaaataacatgattttggaaataaaagttactgccttccaatg

SEQ ID NO: 66880 - DNA, 550 bp, Homo sapiens
cagttacccacagtgttcaccacagtaacatgctgtacagaaacccaggagaaataggctataccctatagcctaggtgtgtagcaggctctaccatctaagtatgtgcttttgcatttctgatgactggatggccccactggatccatgactcttgactcaactggtcctatggccactactcagaagtggactcagcttcaggaaggccattttccctatccctatgattgctttctcaaccaatcagcagcacccattccctagccccctgcttgccaaactatctttgaaaaaccctagcctccaaattttcggggaggttagtttgagtagtaataaaactctagtctcccttctagcctgttttacatgtattaaactgtttctctattgcaatttccttatattgataaattggctttatctgggcagcaggcaaaagaaacccattgggtggttacaactgctattacaaccagtaatatatgaccatcatatggcacccaaataacatgattttggaaataaaagttactgccttccaatg

SEQ ID NO: 66881 - DNA, 1515 bp, Homo sapiens
cgcgctattcattcagagaggttctgcagttccccgtgggcggtgtcaacgggctgctcagcaagggcaacgatgccgagagggtcgggggctgcacgctagcgtacctgccggcggttctggagtacctggcctccgacaccctggagttggcgggcaacgccgtcggaacaagaagaagacccgcatcatcccgcgccacctgcagctggccatccgcaacgacaaggagctcgacaagctgctggcccgagtgacaatggcttagggtgacgttttgcccaacatccaagctgtgctgctgtcccaaaggattgggagccactaccacaaagtccagtatgaataaccacccaagttgtaaaagccagcgaagtgacttgaatgtctaatgtctagaagaaacaaaaacaaaaacaaaaacaaaaaccccaaagctgaaatcaaaggcccttttcagagccactcaatttctgagaaagagctagtttacaaaaggattacaaaatgctgtttcgtcaataagactacagctttcgtaaacaggactcagaacagttctggttattggggtatccgaagcagtttcctttaatactcggtagtattgacagcagaacttgatgtttctgggtggaactgtttcagcacctacttcaggtaggcagagcagtgattatagcaggctcctggaagggaaaatgccattcttcttgggaaaatgaacaaacaaattaggatgttattgtgacaacctatgtaattcctgagaaaaataatgtgaagatggggaatcatattttgggggttgaattttagttagagtgtcgaattagactaaatgattagaagcaaaggaagatttgtaaacttgcagctttcagcacaactcttgttgggagagcatgactgtatggacatcagtcaaggaatgggcatatctaaacatactcctagggcgcatgttttcttctgccaaagaattaccttccgagaattctaggatggttatatgtctagaagaccgtagccatgctatgttaataaaccaaaagataaaaggtacatacaggcttttgcatttctgatgactggatggccccactggatccatgactcttgactcaactggtcctatggccactactcagaagtggactcagcttcaggaaggccattttccctatccctatgattgctttctcaaccaatcagcagcacccattccctagccccctgcttgccaaactatctttgaaaaaccctagcctccaaattttcggggaggttagtttgagtagtaataaaactctagtctcccttctagcctgttttacatgtattaaactgtttctctattgcaatttccttatattgataaattggctttatctgggcagcaggcaaaagaaacccattgggtggttacaactgctattacaaccagtaatatatgaccatcatatggcacccaaataacatgattttggaaataaaagttactgccttccaatg

SEQ ID NO: 66882 - DNA, 337 bp, Homo sapiens
gcaagactcttctcaaaaataaataaataaatttattttaaggcctgctcatagacctgagccatctgtacactgtagccctgttcttttggccccagcctgtgcctgtgcctgctgtgatgttttcatttcctttgctacactatttactatctggcctttgcagacaaagtgtaaaggcatttcattttgcaaacctttaaggtttgcattttcaccttctttactgactagctcagatctctcctacttcaaacagaatgaccaactctgtcctgttatgactcttttatttcacagcttctcaacagtgaaatacaggagtactctgtgcaaa

SEQ ID NO: 66883 - DNA, 630 bp, Homo sapiens
aaaataaaatccatacatttctgagtcctgaaaaattataaatacttgtaatatagttttccttgaacatgtggtctctgcctgcaaacacatagacttttagttttaatttacatagagttaaatatacacatattactctgaagataaacctgaggtgtaagaaaattatgaattgagtgtttttgtgtgagtataggtttgtacatattttcagaataaaagcaattactgcaacaaaacaaattatgttatttaggtgattaacaaaactaaacacttttaaaatggtgaaagcaaatctatactttctgctttgtattgaatttattaatataaaatgttctggcctgtgattcggattctccccagagtctgcctattaaagcacaggcaactttgtctccagaaacaactctcttgagtacaataataaaagccctcttaaaacaggaaaaaaaaatcatttttaacacttatttgaatgaacattcaaccaaaattgaataattggatatatttttattgttctatgtgtgtgtgaatgtataaatggtgcataaaaaataatttaagccagaaaaatagttatttgtaatgaataaaactaaaaagtagttaattattata

SEQ ID NO: 66884 - DNA, 466 bp, Homo sapiens
atccaagatagatcaactctccctaaaggctgacagtgaactcttggggccgttttattctctgaggttagcaaggagtcatctactagccattcaggaggccagctgggaagacaaaataggcaccccaaactcagcaacttcataacaccttcctctccccgcctgaagccttaaactgcatcaagtcaaagaaacctggggcaaatccttaacatgtttttgactgcagtaaatccacagccactctctactccgagctggcagattgagaccaagtattcaacgaaagtgctcactggacttgccagacaacaagtggcgcagataaactcagagtacgagatctggcccgtcaaaggtgctctcagaatcatcatctgcatttggcggtacctgtcccccctcaaaacccacaggttcctttcttttccatccaacaattaaagatctttgacactaagca

SEQ ID NO: 66885 - DNA, 1023 bp, Homo sapiens
atccaagatagatcaactctccctaaaggctgacagtgaactcttggggccgttttattctctgaggttagcaaggagtcatctactagccattcaggaggccagctgggaagacaaaataggcaccccaaactcagcaacttcataacaccttcctctccccgcctgaagccttaaactgcatcaagtcaaagaaacctggggcaaatccttaacatgtttttgactgcagtaaatccacagccactctctactccgagctggcagattgagaccaagtattcaacgaaagtgctcactggaaattggatggaagagaggagaaagttcaccagagacactgacaagacaccccaatccatttacagaaaagaatacatccccttcccagaccacagaccagaccagatctccaggtggtatgggaagaggaaagttgaggggctaccttacaaacacctgatcacccaccaccaggagcccccacatcgctacctgatcagcacctatgacgaccattacaaccggcatggttacaacccggggctgcctccactccgcacttggaatggacagaagttgctgtggctgccagagaagtctgactttccccttcttgctccccctacaaactatggactctatgagcagctcaagcagagacagctcacacccaaggctggcctgaagcagagcacttatacttcatcctaccccagaccaccgttgtgcgctatgtcctggagggagcatgcggtcccggtccctccccatcgcctgcatcctttcccacacttctgagagctgccaccccaggagcagctcagatagaatcagctggagaccacagcctcactggacttgccagacaacaagtggcgcagataaactcagagtacgagatctggcccgtcaaaggtgctctcagaatcatcatctgcatttggcggtacctgtcccccctcaaaacccacaggttcctttcttttccatccaacaattaaagatctttgacactaagca

SEQ ID NO: 66886 - DNA, 239 bp, Homo sapiens
tgtggtttacctccattgcccacatcctcgtccatgacactattgtatcttacctgggctactgcaatggtgtcctaactggtctccccgccttctttttgtgtgctacaacctattttttcacaaagcagctgtttatacttgttaaatgtaatttgactatgtgtaactccttagattaagcccatccactggcttttcggtgtatttacaataaaatccttagtccacgcctctct

SEQ ID NO: 66887 - DNA, 93 bp, Homo sapiens
ggttctggtttcatagcaacttctaggtggtgtgggcgaagtttgggactggtttagggcggggacaagaccaagaacacaagtttccttgta

SEQ ID NO: 66888 - DNA, 2946 bp, Homo sapiens
  misc_feature (1581)..(1581): n is a, c, g, or t
  misc_feature (1627)..(1627): n is a, c, g, or t
  misc_feature (1661)..(1661): n is a, c, g, or t
  misc_feature (2628)..(2628): n is a, c, g, or t
caagagtggccgacaacccagaaatctgatggctttcgtggaaccaaagtgcacttgttttggtttttcctaggtttggttttgcttttttctttattcacacagagtttattgcttccatctctggcgtttctgcatcagtaggtacacttacatgggcaaagctgaacaggatgcaaatcaagcccagccattacatgcttcttccaggaagtgacacgcatcacttcctctccatttcattggccagagcaaatcacatgaccacacttcacctcaagggggctgggaagtctaatcctccagtttatctagaagtcccagagaagcagatgttggaaatacctcccccaagtagacaaatgagtgagactgttggagggagaggaaggagactacttatccttccagctcctgatggtctcatccccttgttatgaagtattcccttcctgatgatccagggtgtcacttcacctgttgttgctgaccactagcatcccctccttctcttcagccctccataccccagagatgcactttgcagctgcagctacttgctgcaaacctacttccaacagtctgcccagactaacagcatcttctgatctctctctgcgtgtgccagctccaagtgagcacagactggaaacacccgacacctcacctgaaaactctttcagaagagggcaggcattgtggatattggtcttagtcgtagcagtagagcttccagtagacatttaatttttaaaatttttatggattaccatgtaatccaagaaacaggaattgccactgctgtgatattagttctcaggtcaatttaaagctagccttgagcagacaggggattaaataacgtgtccatttcagtgacctttcattctgtgtgagatcaccatccccttgaagttggcaaaatgagaacctagactgctgaagcctgcctctaatgagccactgtaggtatatcttgggagttctccatggccagggacctgagctcatgtccaagtccttacagtcttataggactgtccatagcgtgaattggtacaatttgttttttcctcagctttccccaccatggtatgaggtaagaagtgctgctctgttgacttagatagaaatatccttctgtccacttcacaggtttaaactggacccatgtaagttcagctctgaggctcaaatttggactgaatgactttacgtaattcaatgtttttcagatgtacaactgaagagactataaagctttagaactagcttctgtttaatccccaccattattgagtgacaggccaaaacataggcgtatttaacacagaactatgatataaccctaacccaaccacccttccttccttccttccttccttccttccttccttccttccttcgttccttccttccttccttccaggttctggctggtgtagtttaatttctttcctatcaaaatgtcttaccctaaatgggtaagaaaataattgtataacttgttagcttgcaggtagggaaaatttttttcttttttctgagacagagtcttgctctgtcacccaggctggagtncagtggtgcgaccttggctcactgcaacctccgcctcctgggttcnggtgattctcttgccttagcctcccgagtagctngtattacaggcgcccacactgggctaatttttgtatttttagtagagatggggttttgccatgttgtccacactggtctcggactcctgacctcagttgatccgcccgcattggcctcccaaagtgttgggattacaggcgtgagccatcacgcccggccaaaattttaaaaagaaaagaattgtaaaacacttttaaaatgaagagtttattagatgtgcttcccaaaactggctctgtaaatccattatagagaacttttgatagtgtccaccttcttgcttcattccccttagggatttactgcttactactaccaggatctctttctacccagataacactctgacaccaaatgtgtaggtttcttacaccaaaaaattcagttctctgcagacaccagctgggtgtcctacgatttaattcaattctgacactacctggagttagggcagagcccacaggttaagggctctgtcccacaggagtgcctcacacttcagacaccaatcacaagtagtggttcttcagattacccacacttctgtccaacttggctacaaatcagggctcccacaaccccttcctcaggctcaataatttgctgtaatggttcatgaaactctgagaagcactttactcactattactagtgattttaaaggttattataagggcacaggtgaccatccaaggtgacgatgtacatagggcaagttccagaagggtccaggagcttcagtccccatggagttggggtatataccacctcctggcatatagacatgctcaccaaccggaagctctctgaacccctcagttagggtctttatgggggttccattatgtatgcatgattgattcattcattggccattggtgattaactcaatctttagcccctctcccctccccaaggcctggtggaaggggctgaaactttcaaccctctaataatgccgtggtntttctggcaaccagtccccatcctgaagctatccaagattcccgaagcccggtcatctcattagcatgcaaaagacacgcatatcactctggagattccacgggttttagaaactctggtccagcctggccaacatggtgaagccccatctctattaaaaatacaaaaattagccaggcatggtagcatgcacccgtagtcccggctgctcgggaggctgaggcaggagaatcgcttgaacctgggaggtggatgttgcagtgggccaaggtcgcgccactgcgctccagcctgagcaacggagcgagactctgtctc

SEQ ID NO: 66889 - DNA, 473 bp, Homo sapiens
cttcagctgaggatgcagccaatcctaaaggcagttctggaaccaggatggctcttcagagttgttacaaattgagacaaggtgctggtattttgcatcagccagtaattggctgtgagctctcctatgggcgggtaaggcagttccccactcccaagggcaacttccagggagggatgcagctgtgagcccatgcacctgacattcccagcaatggggaatggatatgttgctcttgaggagtggatgtggatggagcatccagcagccattacctgttccatctaacctaagatattttgagatgcccacttgtttttgagacttaatgagaattatttggcattctctatctctgaactgctcatgccaaatcttagtacccgatataagtggagtctggttgcatgatcagttgctcagatcaaagtgggaaaaataagaaaataaatagaaatttggatttgatcact

SEQ ID NO: 66890 - DNA, 385 bp, Homo sapiens
taaatatttcctcttcccactgacactgttagtgagaatcagtggttaccttttgtcattcctacaatttttgttaatatcccactttgggcacttttcatgttttgcattataatttttttgttcatgtctgccttccccaccagccttcaatcttcttgagattgtgggccatggaccatgtcttaattatgtttatgtaagtagcacaatgccttatccagagtaagcactgtgatgaatatttaatttaattcacttcttaacatctggcactaggtcattttgaaataatgactatcaatttttttacacttcctgttaaatgtaggctttcagtgtttttgcaggagcaattgtgtgtgaaatattacacacacacata

SEQ ID NO: 66891 - DNA, 366 bp, Homo sapiens
tggagaaaccacattcttttagatttggtgggcacgtaattacagtgtaggtggtatattcttcttgacgaaaatcttataaagcacttacaggaacttggatatttgtaatgaaatatagtattagattttcatttttatacattttcttttcctctaaccatagccattaggactgttttgaaagagtttttagctcctataaaaacaaagtgcccccccgaaaagaaagggtcttttaactcttcaaggatcatttgggctgcctgggtccttgctttagagttggagaaataatattaagcagtcataaaaagggattcttaggcacaatacacaaaagctgttttatatactgtttttcat

SEQ ID NO: 66892 - DNA, 634 bp, Homo sapiens
cattctctaaaatgctgttcatcttagaccaggaaaaatattaaccttacagactctgtttcaattcatagctaaatattttcaaaagagtgactttgtaaaaatatgttccaatggcaaattgattcattgtgatgggatcacttattccaaagacttcctgtctttattttgttgccatgcctaccttttagccatgatacaacagaatcaaatattggccactgggaaaaaatattcaaagaaagaaagaatgtgaacagaacttatgaccatgatgattcaatgttttaccacaatgctttctaaaacagaagagtgtaaaaggatattcaaagtcaatttcctcaccgaggctttgcagaaaatgaggaaactagagaaacaaaaatggcgggacattctacgggtgattttaaatgttgctatgttttatgggaaaaaatactttaccttttaaagaatcacaaagaattgttggaaacccaaactctggaatgtttgcaaatttagttgagcttctatgtaattatgtctatataggtagccacaaagttgatgatttttaaaaatctgtgccttatttgtgtaataaaatacacaatgaataattaatgttcctaggaaaacctta

SEQ ID NO: 66893 - DNA, 473 bp, Homo sapiens
tgaaatctcaccgcgtcgactaaaaaaaacatacaaaaattagctgggcgtggtggcacatgtctgtaaccccagctacttagaggctgaggcacgagaattgcttgaatccaagaggcggaggttacagtgagctgagatcacaccactgcactccagcctggaggacagaccaagactccagtcttaaaaacaagaagaaaaaaaaattaaaatcaatggtgtacctcagtataggtggacaaaacagcactagcaagaagggtgtcagcaataggtaaaaataaaaggaaatccttaaaacacattagaatgagaagccttacaaatggtcaagaaaaagacttagatcaagttgtgggttgaagaaaaattaataaagtcggaagatgcaaagatagataaacgttactacagacagaatcatttatagaaaaaaagtcgacgcggccgcgaatttagtagtagtagta

SEQ ID NO: 66894 - DNA, 285 bp, Homo sapiens
ctgtgttccaggatagtttctttctatttccttcagggcactgaaggtaaagatcaagggtactacttttagcagaagtacttgcatttttttccattctaagagatgccaaaagttagacctctaatgcggaacttgacagggtgagaaaagaattcagcatctgtccgactacacagtatgttatctactcaaaagtccagccctggaaagctgtccttccacctcaggaggaaatacagctgcttgctgggttgttcacttcagcatcttcaataagatgag

SEQ ID NO: 66895 - DNA, 251 bp, Homo sapiens
aagattataggcacaggctttctccaatgtggcacccaactgcaatgcaaatagtacacacatcactcaagcattttccaatcttattttggaattctacagtttcaaatgatttatgcaattttttagaaaaaaatggataaatgttgcatatattttatacattttttctaaagaaaaaatatgttaaaggaggaaatactaaattcttagaagttagtatgagggagtatgtcccaattagcattcag

SEQ ID NO: 66896 - DNA, 3487 bp, Homo sapiens
  misc_feature (379)..(379): n is a, c, g, or t
  misc_feature (962)..(962): n is a, c, g, or t
  misc_feature (3480)..(3480): n is a, c, g, or t
  misc_feature (3482)..(3482): n is a, c, g, or t
  misc_feature (3484)..(3487): n is a, c, g, or t
ggacagggggctctgttgaagctggtgctggagacgctgggtcaacagtagccatagaaggtggagaaggagtttgtgatggtggtgctggatccaattccgctgtttccacagtggcctgacactcctggttgtcttcgtaagcagccagtgtcttcagatactctttcttggcagcctcagttttcctcttatatatctgtttttgctcctctccaagactatcccacatggaggccacaatttttgaaacctcaccaaaagtggcattaggattctgtcccttgatggcagcccgtgtatcaggaaagaataaagcatatgctgaaactggtttctgaggttcattaggatctttcttttttctcttctttgggancttctgctttttccctgcttccaccaccactgtcttctggctggaaatttgcctccagaaatcctcaacaccaacctcgtgaagtgaactagtaggtgaaggggtggttgaaatacgatcttcaggtgactgggcaggtggcaggatggtgccaccccgtaagctcaaacccagttggaaactcagttctgactgatcagtggtggtcaactggctatgccccatcaagtcagatgtcatgtctatcattagtacatcaattgtaacaggtgggttggcactatactgagttcctatagagtggtttaagtccatgatcaagcctccactgaggagcccccaccttgctccatcaagccatgggtcatgcccacagagcatgtccaatgtctggaccccatactgggctgaagcactgccatcctgtgaagaggaagggtctgccaggtcatcaaagtggtcaaccacatctgagacagccaatgagggatcagaatccaaagagataggtgggatttcaaattcttcatcacctaagcttggtgtatggaatgtctcggcccctgacaggaagaggtgtganggccctgtgattgtcaggtaattgtcatttcctccgggagactccatcttcacacaactgctcctaccatctcagactgtcatcgctcccaccgccccactggactcggaactgtgagaccacttcttgtatcatgtgtatcctatttaactttccttaaacaagcctgtgttccttgcatctaaaaaccttaaaatgtgtgtgaaacccagcatctcagaaccaggagcgcaccaaactcacattatgtggtaggcaacactctaaagatgccctcccccaagattcttatctgttggttgttcaaacagtaatacaggcactgctgtaaagtcccaagtcagttaacttaattaattaataaattaataagtattaattaattaattaagacagagtctctgttgcccaggctggagtgcagtagtgcgatctcagctcactgcaacctcagcctcctgggttcaagtgattctcatgcctcagcctctcaagtagctgggattacaggcgtgagccaccactcctggctaatttttgtatttctagtagagacgaggtttcaccatgttgccaaggctgggcttgaactcctgacctcaagggatctgcccgtctcagcctcccaaagtactaggattacatgtgtgagccaccatgcctggttgaaagtcagttaactttaaaatatggggattatccaggtgggcctgactcaattagctgaccccttttaaagcagaaagttttctatgactggaagcaggagaagtcagagaaatttgaagcatgagaaggatttagtgtgctgttgttggccttgatgctggaggggttccatacaaggaccacagagtggctacaagtaactgagacaaacccagctaacagccaacaaggaaacagccacctcagttctacaaccacaaggaactgaattttaccaacatcaggaatgagattggaagatgatcccaagctccagaagagaacacagccagctgacagattgcttttaggcctgtgataccctgagctgaggtgccagtcataccatccaggatttctgacctatggaactgtcagataacaaacaggtattgttttaagctgctaaatttgtgataatttattaggcagcaatagatgactaatgcatgttgatttcaagtgaatgggactctctggagctgtgtgaggctgcaacccttaatgtaaataattttgtgaccatgtgttatcagagtcaaatacgtttggaaaaccacattttcataatcaggatgaaaggttaatgatgttgagtggacttatagcagagaccgatcacagaaagcatggaggcaacactatgaaacaaaacttgaatactcaagtgtggaggttaacgatacagaaagcagattctatcagtgaaaattaaagcaactggcattcatctaggaattaaccttagctcaagtggaaaacacaactaatattgctaactctaactctgctttggtttaaaggatgaaaatatggtgaataaataatgataaaaaaatagcaacaacaaccattgatgaaacatttactctttgccaggcaccgtcctagcaaggttacatgtgctctaattctcacaaaagttttgaagttgatactattaatcgtcttttaacctttgggtagtagtaatgaagaatggtcctgagattaatcaggaaagagatgggaaacaaaggcagcattttggcacaggaagtttaaatgcctgttttagtttcatgatgtgcctttaatcttggagtctcaataatccttagcagctctggataaaggaggaaacacactctttaattcatgaaactcaatgcacttaaaacacctggtttctgagccagaaccagtaaattaggccctctttatcacttgttttaaaagtaattcatgctttatctgaagcatatcatgtaataatgcatataatataggttaaaaacatttactgatcttaaaaaattggattaccagtacatttgggtcacatagtagtagagtactcctagagataatgatgccctattcctagagtctaagaacagatggcaatcaatttctccggcattatctggtttacagatatataagagcgataaaaatcaacagtaataaaatactggtaaccataattttcaccaattttattcgtgtaccacaaaaatgatttaattttcttaattaaataagcactaaaataaaaatcatggaaaagaagatgggctcaatctccctaagtgatggagcactcaagcatttttactttttcactgagacaaaaaccaaaagcaaataacaaacaaacaacaacaaaaaaaaccctgtccacccaggagctaatccattttccacactcattatcattcagatgagtcttttgtaagacaaagatgtcagcatagcttctttcagtgtctgagaacgcctttcttatttggattgtacaaataaagaggaccctctggatctaattaananannnn

SEQ ID NO: 66897 - DNA, 440 bp, Homo sapiens
ttatagcctgcaaatgtcaggcagttgccacctaagcaagaacccgaaagctaaaacagagatattttgctgatcagaaggcacggtggctttcattaaaccaacagtattaactggtcttatttaccgaagatttacccaagttatgtgaactaaaagggatttgagttactttctatttttctgataaaatatttaagtgtttcctttctcttttggccaattagaactcattcatatatttttgtaataaattttacatacacatgacacatataaacatgcagacacacacaggcagattttatagctttgtaagtttcttcatttgccagttttcaatagtttctctcccacctttagactgtcaagccctaaacaattgttagctaggcaaccttaaatttgtacttctaaagggatgactcttagctgaaaca

SEQ ID NO: 66898 - DNA, 253 bp, Homo sapiens
cttccttttctttttctgttttagagaggagactcaatctgttgcccaagctggtctcccaggctcacgcgatcctcccaccttggcctcccaaagtgctgggattacttacaggcgtgagccaccttgcccagccgactcggccactttctagccaagtgaacttgggcaagtcacctcctttcttggggcttaagctgctgtgtctgtaaagggggtatcggtgcacacttcacagaatgatggggagctt

SEQ ID NO: 66899 - DNA, 202 bp, Homo sapiens
acactcagtgttaacgaagctcattggtgaaccccctgcattccccaagagaattcttcccatagttgccttcattttacactgcactgcttccaatcaagaaaatagttttaatttagaatcaaaatccagagaagtaaggaaattatagctgttatatcataataggctctaaaggaaagacaacagtgaaactgttgcc

SEQ ID NO: 66900 - DNA, 977 bp, Homo sapiens
tgcatggcagcattatgagctcttctataaactagcttaataatgagctctattctgaccatctattctggaacttggagtgggggtggggtaccacatcctcagaagtgaatgtgtacagtcggtgatagtacaactgagtaatggggcttcatacccttggcctctttttgactgctaagaatttggagaaggctattaatgaaggtaaggtaatgagccagtccaaatccctcactgtctggctaagagattgagccattccactttacagcccctaattcccttcttcccaactgcagcaacatttccaacagggacaaaaaggaagtgaaggaaaccacttcagtattgggatcaatagaaattcaagaggtagttcataatgaccttatatgtgacacaaatggaaatactctacacttctggcatgcttctctcccaaatatttagaacattagtgacaatatgaaaaactttgctgactgagctgatcaatggaatgtgaaggcagtatactttaaggctatttactttcacacagaatgtttatctattagtcagtttgtattctactcaaatgcagatagacgggtataatgttttcttgtgcatttgaaacctatcaaggagaaaataaaccattccactaaaatacataggccaaacaccatctgggaaagtgataaaagctatccagaggctatgctatgtaaaatagcaaggtcaatttacatgggttgcatagtacttggctatgcagttttcaaaagaacacatccaaaaaaaaaaaaaatccaaattagttcctataataggtctttgtaaatttaaatatatttgtgggttggaaaatacgtttttagagacatttagaatttctttctctaaaaatgtatccaactccaagcagaaagagacttctgtactcacattctcatgtttcttagaattgggtagcatgatcattgaatctg

SEQ ID NO: 66901 - DNA, 1406 bp, Homo sapiens
  misc_feature (893)..(893): n is a, c, g, or t
  misc_feature (902)..(902): n is a, c, g, or t
tgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctctgacccctgcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttntctcctgcncatgagcaccacagtcaggccttgatgggatcttctagggagacaacagccctgtctcaaacccagcttgccagctcccatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 66902 - DNA, 1561 bp, Homo sapiens
  misc_feature (1048)..(1048): n is a, c, g, or t
  misc_feature (1057)..(1057): n is a, c, g, or t
tgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctctgacccctgcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactggtatcgccagacacctgcatgctgtgattaggtactcagtggccatcatcctctttaccatccttcccttctttctccttcatcgctggtgctccaaaaaaaaaatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttntctcctgcncatgagcaccacagtcaggccttgatgggatcttctagggagacaacagccctgtctcaaacccagcttgccagctcccatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 66903 - DNA, 1353 bp, Homo sapiens
  misc_feature (840)..(840): n is a, c, g, or t
  misc_feature (849)..(849): n is a, c, g, or t
tgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctctgacccctgcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttntctcctgcncatgagcaccacagtcaggccttgatgggatcttctagggagacaacagccctgtctcaaacccagcttgccagctcccatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 66904 - DNA, 1121 bp, Homo sapiens
  misc_feature (608)..(608): n is a, c, g, or t
  misc_feature (617)..(617): n is a, c, g, or t
tgcgtcctggcagcagaagctgcaccatgtccatgtcacccacggtcatcatcctggcatgtcttgggttcttcttggaccagagtgtgtgggcacacgtgggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttntctcctgcncatgagcaccacagtcaggccttgatgggatcttctagggagacaacagccctgtctcaaacccagcttgccagctcccatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 66905 - DNA, 1457 bp, Homo sapiens
  misc_feature (944)..(944): n is a, c, g, or t
  misc_feature (953)..(953): n is a, c, g, or t
tgcgtcctggcagcagaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactatcgtcgtgggtttaacatcttcacgctgtacaagaaagatggggtccctgtccctgagctctacaacagaatattctggaacagtttcctcattagccctctgacccctgcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttntctcctgcncatgagcaccacagtcaggccttgatgggatcttctagggagacaacagccctgtctcaaacccagcttgccagctcccatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 66906 - DNA, 1172 bp, Homo sapiens
  misc_feature (659)..(659): n is a, c, g, or t
  misc_feature (668)..(668): n is a, c, g, or t
tgcgtcctggcagcagaagctgcaccatgtccatgtcacccacggtcatcatcctggcatgtcttgggttcttcttggaccagagtgtgtgggcacacgtgggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggaaacccttctagtagttggccttcacccactgaaccaagcttcaaaactgatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttntctcctgcncatgagcaccacagtcaggccttgatgggatcttctagggagacaacagccctgtctcaaacccagcttgccagctcccatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 66907 - DNA, 352 bp, Homo sapiens
agtattcatccacgttttccacaagtcctactatttatttattttaactttaatttaaatatcacctaccttaggtagaagttttcctttgtgtaatataatataaaaccgacatttcttgggggcataatagtaaagatgttaacattttttggttctttttggatgctgtatttgtgcttcttctgaaagtgatgtgtgccaagatggctcatgtaacccagttttgactaggctattgatcttctgtctggttaatttattgaactggcttaaagctatacatattttcttttagttaactatgtaagatattctagatatattgtctactgattcataatatcactgg

SEQ ID NO: 66908 - DNA, 400 bp, Homo sapiens
ttttttttttaagagacagggtcttgctctgtcacccaggcctaggttggagtgcagtcatagtccactgcagccttgacctcccaggctcaagcaatcctcttgcctcagcctcctggatagctgggactacaggtatgtgctaccatgcccagcttccttcctttaatttgtgtttgcaattttactgcatgggatgtgtattttcatgtttttatttaagatttacttttggattgcagagttacactaggaagcaaaaataattcaacaaatatttaagatctacaacctagatacataagaacttaaaacagaatgttgtaatgtttaatcacttttaggtaaaaatcagtagtggcctgtcagtttcttcatccatacctaactcttcagcttt

SEQ ID NO: 66909 - DNA, 290 bp, Homo sapiens
tctataattcctgtttgtagagaaggtagatagccctcacttttgaaaatcggcaataattagaaaaagagactcctgctatggtttgaatgtctctcccataattcatgtgttagaagcttaacccctaatgcaacggtattggaaagtagggtctagtaagaagtgattaggtcatgagggcagagacctcatcaatggattaatgttggtctcacaggaatgggttaatcattgcaagagtgggcttgttataaaagcaagcttggccctcttttgcattttcgctc

SEQ ID NO: 66910 - DNA, 3319 bp, Homo sapiens
  misc_feature (530)..(530): n is a, c, g, or t
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcnagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgcccttagcaaattctgtttttctaggcctggggacggcttttacttaaacgccaaggcctgggggaagaagctctctcctccctttcttccctacagttcaaaaacagctgagggtgagtgggtgaataatacagtatgtcagggcctggtcgttttcaacagaattataattagttcctcattagcagttttgcctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggaggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctggggtgacagagcaagtgagaccctgtctc

SEQ ID NO: 66911 - DNA, 3225 bp, Homo sapiens
  misc_feature (530)..(530): n is a, c, g, or t
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcnagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgcccttagcaaattctgtttttctaggcctggggacggcttttacttaaacgccaaggcctgggggaagaagctctctcctccctttcttccctacagttcaaaaacagctgagggtgagtgggtgaataatacagtatgtcagggcctggtcgttttcaacagaattataattagttcctcattagcagttttgcctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggaggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctggggtgacagagcaagtgagaccctgtctc

SEQ ID NO: 66912 - DNA, 935 bp, Homo sapiens
aaattgggattgggtcctgagaagatccatggaagcccagaggaccctgcctctctctgttgcttcatgctgtagaggcagtactggggagggcctgccccacatccggcagggcagctggaaccatgtgtttgatgacactctgctccctcaatgtggagcctcatcctcatctcacagtctagcaggcctctggtgggttaggcttgtctcacccagtgtgtgagtttttttggaagtgacctgattttggagtttccctccaagcctttctcaggtacatgctttctcttttattctgtcttctttttttgatcttcttaaatctgattttctcctttttccctctcttgtctccatcttttttccagtctctcgcttctctttatttctccccatatttcactctgttctctcaccccaacctttcccttctgtttctctccctccctctcttcccaccccctgcctggccttccatatatcaagcagagttttatcaccttatgcaggggcagccctgccacctgccataaagttgataggctaatgacattttgtggatattgccatgtcacaagtccaggacagcatcaaaaatagccctgatgtctaaaccacttcagctatcttttttatttttaaaataaatacattcacatgcttttaagaaactataaaaatatataaagtaaaaagatctttctctcacactgtctccacctctcctggtctcaccgttgtgcttaggggaaaccattgtgattagtttctcctgtgtccttccagagtgtctttatgcaaatgaaaattattgtgataatatattcctattttcccccttactacacaaaagatagactaccataatcccattctgcacttttttttcacttgataataaaaacatgattttattaatgggtgtttatgga

SEQ ID NO: 66913 - DNA, 730 bp, Homo sapiens
ttgaataaattgttgtttctttggttgaaccatgatgagataattggcttaaaccaggagtcatgcatggtatctggaaacttcctcacttgaatcaccagcatcatactcagcatgcataatcctctcatcatgagaggcacaggggaaatgagccagcctgtctggaaaggaagcaaatgcatgctttccatctcccactcagtactggacatgaggctatgtcatcaccacttaatgccagcaccacttaaatgatgtttctctctctctgccctgtacttgctggaggcacatgcccatatcacgtagggtgtcagggcagagagctcttaggaagagctgagctgtggggacttcctcccacgcagaagagggaggcctccgcagaattctctgccatgtgcttctaggcttcctcaactcagaaattttattatagagttttagaatgtgaagagctcttggaaatcatgaaagatgaagaatcaagatggaagtttgatggcttgtcccaggccccagagtggaccctttgctttttggaatccaacagcaaggactcatgggaatatcgtgggatttgacttggagagacagggctcaaacctcatctttgtcacttagtgattgtgtaattctctaaaagtctatttgtagaaaagggataagggagctttctttcctggattgcaagatgattaaaagagatgtatgtataaagggaaaa

SEQ ID NO: 66914 - DNA, 434 bp, Homo sapiens
cttttcctatccctgtacccatagctctccgtagactcagaatttttccactgccatgtctttgcttatcttgagtgacagtgtttgtgggtgaaccttgaaggtgctctttctgctacaagggccctgggagatagcatgggcatgtgcattgagaagccagcctcagaccttatcttgaagcagcttgaggccagacctactgtaggctcagcatcttgctaggaggcatgggagtgatctaacctgccagctatctctcttcctttcctccttctgctgatcaaagtcctgtcctttaagaccctgaagctttcctaggtggagttgatctctcttttcagtattctttgtcctcttgtgggtcatcttactctacttttatttagtaaataaaataattgcaataaaaattattttattgaaaactccat

SEQ ID NO: 66915 - DNA, 383 bp, Homo sapiens
gatttaaattaagtacccaaaacttgtttttagaggctggaggaactaactgatctttgaatcagtcccttttgagaacctgctttttccaaatagcatcatgagcgtggtggtctggttttcctcttctatcttgttgtcatagataagatgcacatgaagaattcatataaattgctctcagatactatggattcctagcatattggattaaaaaagaagtggatatggtccttcgatagaatgtgaagtgtttttttaaaaatcagccaagaactatgcctgtctttttttcacacctgtgattctttcagcaagttagaaggatagcaagagaatgtgcatccttccccaaaccccgaagacaggcagctttggcttaa

SEQ ID NO: 66916 - DNA, 302 bp, Homo sapiens
gggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactct

SEQ ID NO: 66917 - DNA, 1249 bp, Homo sapiens
agacagggtctctctctgttgcccatgctggaatgcagtagcatgaacacagctcactgcagcttcaacctcctgggttcaagtgatcttcccatctcagcctcctgagtagcagggactaccgccacacgccaccacacctggctaattttggtgtcttttgtagagatctttcgccatgttgcccaggctgatctcaaacttctgacctcaagtgatctgcccatcttggcctcccaaaataatgggattacaggcatgagccatctcacctagccaaactttcaataatagtgaaagtagtgtatcagagaggttaggattccttctatgtaagaatagggagcagttccttccaaacattaccaatttttaagaaaattaacttttcagttacttgaagaaatgaagtaacagatcaaataggtttttgaaatcttgttttaagtttctgaaatgtttttttctctctgctcagaagtgacaacaggtctattcgtgagactgtcttttgagcttttcctgggggttcatcaatcttttcagagcactttctaagaaaagaatgaatgctactctttgggctatagtagtagtgttaacataaagttgggtagctaaactgtaatatgtggtatatattaattagaataccagacacaggtgttttgattagatttggtggatggatgacagaagttagatgatgaaagcagtgtttgagaaagagtaagtcctattatcagttggagaaagcagaatggagtccagccagctaacaatggaaataacatgggatctggtgcagtaatgggaaacggagaaggaaaaaaataaatcccaggcacttaaataagaagtgaaccctgggttatttggcaaaaacaagagaaaatgatagtgtagggtgatagaataaatgtttattacatttcacagtattttcgtaaagtgatttgcagtggacgtgagtctgaaaagtgggagcaaattctaaaacctctgtccttgggactaaaggaaggtaatgtcacagtagttactgaagaggatctaattgagtgtgcataattatatttctgaacaccatatctgaattttacataggagtttcactttggtgatttcagctagtgattttcagtctgtcctgcagaggtggactgggtagctgggggagagaaaaagaaagaaagaaagctaggtttgattttatctcttgagattctagtatgtttaaaaaaaaaaa

SEQ ID NO: 66918 - DNA, 887 bp, Homo sapiens
aggaaggcaggggtgggagggtcaggagggcagggtgaagggggggctggagggcagcggtgacgagggcagcctgtctcccacgtgtggtggctgcttcctgtgtgccctggggttggctctgtggaggggtgggcactggctttggaacacctccctccccttcctcctctgccacccagtgccttctaaagggcagcagaaagaggcctgctaggcaggggtggcggaggccaccttccttctcacaaatacttcttggccctggccctgtgctgcccgggcaggtccccaggctcaggggctgagaggctgcttactgctgcaggtggaggccccatgccggagggagagcggggttccccccatgcctctccagccctcctgctgcccacggcccaagcccaagcttgtgccggtcattacggccttgcctagctggcagggacagctgcgtgtgatgctggtggagatgccagatgccgcctgccctgtgaggacggctggcggggccgtggggggggttgtgggctggcggggctgtgggaagggggctgccgatcatggtgaaaggggacattttcattgggtcctcgtggtccgtgtcctgggtactcggggtcaccgtgcagacagctgccctttgtctgccggacacagtgcaggcaggggagacaggtttagggctctgacatggggcacagggactccgagccaagggatgtcagggcagctctgtgcatctgaggcctttgcccttgctttgcgggtcagttcatgtccaaagcactttaggaggctgcagggatcaatacccaatatacccaacaactggaattgtttacacatgacctacattttggacggtttatcaataaacatgtgtg

SEQ ID NO: 66919 - DNA, 1273 bp, Homo sapiens
  misc_feature (2)..(3): n is a, c, g, or t
  misc_feature (617)..(617): n is a, c, g, or t
  misc_feature (784)..(784): n is a, c, g, or t
tnncacacagaaattccttttagggactcttgataatggtgagtccatgtaaggctgtgagttatgttaataagagcattatttttctttgagattccacattgtcgtcactttttttttgaaacagcttaagaaaaaaacctttctttcctcttctttctttccctttcctgtattcactctttctttcttcgctctatcttttttcagtaatctctgagacaatgtagacacagtccctgcccccaagggtgggaaaaactagtaggaatgtggcataagaattccacagcaacttagaggaagagatgccattcacttaaggatatgtcatgtgagtctttatgtctaagagacagaaggtagcttgtgagaagtgtgaatggtgtttagctggcagtgggaggagactttctaaatagagagttacggagtttcatgagaaaaagtaggcaaaaaaatgggatgtgtgcaagcacacacaaaaacagagatgaataaggaccaaggccatacatattccctagggcaaaacaattggcttagatagtgtattcattaaatttacagaacaacatcactgtacttgctgcatagcttctcttaggtacttgttntcctgcccacaaaggctcaatgtttgtccacatacacaggcatgatatacaaactgcttcaatttggggagagggcatttggtggctaagatatttgtgatcagcaaggtgatcacaggtggctagttattttcaaaacaatgttcagactatcatttatttctggnggccctttgaacccctcctttctcttcctcctgtctgagttccaacctttcttaccctctccgccccttatccaggcccatgtcaagttattcctgctccacaattggaaatggacccttgcatttcaccagaccatttttctcttgtgatttcactgtcttatgtttaacattgttgttatttgattcaaaaattttctaagttcccttatgattttttctttgacccatggaatatttagaagtgtgttgcttcgtgtccaaatatttagtaactttccagctatctttctattatggatttctagtttgattttattgtaattacagtgaacactgtgttatttcagttcttttaaatttgtcaaggtttattttatggtccagcatacagtctatcttggtgaatattccatatgcacttgaacagaatatgtattcagctgttgctgggtataatgatattaaaaatatccattaggtcaaggt

SEQ ID NO: 66920 - DNA, 341 bp, Homo sapiens
ttaggaagaaaataccaacagcagaaagatggactggaggcatgagaaagcagagaaaaagaatcagctggaagcttttaaatttagttaacttaaattttttttggacacagaaagactttctgaagtaggagatgattagagtcttaactaatgtaataataatgggaatggatgaaagtaaaacaatatgtgacaggcattgtggaggtagaatagacaggatgtgagaaataaaaagctgtaagttataatggagatgaagtagtcaatatgtttccattgggatttcaaagagtggagggagagacttattaacagagactgcaagtagagaataa

SEQ ID NO: 66921 - DNA, 408 bp, Homo sapiens
cacagagagcggtttgatatgtcactgaaaccagcatccaggtggtattgctccatatgcctgagaccctaacaaaagcctaattacaactcatatgcctggagccaggacatgtgcaggatgcatgatggtccaagttatattgggattcagccaatagaagatattttgcctgtcatccctaagcttaggacaatagactctgccaagagaggggattattacatattgcagagcccagcacctaggtggagtgactctcatctttttcttctaccccgtatatagccagcttggtgacctactatttgagtctatacccaggcccagaccacagatgaaattgtgcaatatgtggaacaaacacctaaacaatatataacaccttccttggctctgtctacaaag

SEQ ID NO: 66922 - DNA, 185 bp, Homo sapiens
ttactaggaacttttcaaacataaaagttgagaggaacatataatgaatgcgatggacccgaccccccaacttcaagaggaaaactctggctctactcctagtcttctctgctggcttgttttgaagctaatccaagacttctatcatttcattgtcaatatttccaagtgtatctgcataatat

SEQ ID NO: 66923 - DNA, 346 bp, Homo sapiens
tttaaatagaactggcggaagcacaagcacaccgtatcagcagcttatcagggaccatggttttccacgtacatttgctaggcacttcagtttacccaactccatcagcactgagttaaattgcaaggttgggctgtactacgctgagccagggcagggagaacaagccagttactggggatgagggtgtcgggggggccctcaagaccttatttgcattctgcccacatagagaataaagctgtgatagcctgtgtactaagaggcacccaaagagaaccagtcagtcttaggaatgcacccggaaggtgggatgagtccaggcctccctatggtggaagtagtt

SEQ ID NO: 66924 - DNA, 1311 bp, Homo sapiens
atggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcactgcatccgtcttcacaaatgggcttgtgctggcggccaccatgaagttcaagaagctgcgccacccgctgaactggatcctggtgaacctggcggtcgctgacctagcagagaccgtcatcgccagcactatcagcattgtgaaccaggtctctggctacttcgtgctgggccaccctatgtgtgtcctggagggctacaccgtctccctgtgtgggatcacaggtctctggtctctggccatcatttcctgggagaggtggctggtggtgtgcaagccctttggcaatgtgagatttgatgccaagctggccatcgtgggcattgccttctcctggatctggtctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtggcaaagcagcagaaagagtctgaatccacccagaaggcagagaaggaagtgacgcgcatggtggtggtgatgatctttgcgtactgcgtctgctggggaccctacaccttcttcgcatgctttgctgctgccaaccctggttacgccttccaccctttgatggctgccctgccggcctactttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaactgcttcttcttccgtgcgactttctctgtctctcctccccccgtacctgcgctgcctccatctttctcgatactaaaacttccagggggggccccggtccccaatcccc

SEQ ID NO: 66925 - DNA, 481 bp, Homo sapiens
ctttgaagaaagaaataccttgcgtatccagacaaaaagaccaaatgacttacaagggaaggaaaatcagactgccttcactctttttgacatcagtgctttattccagaagaaaatgccataatgtatttgagagactctcggggggagaaaatgtcagccagggactttatgtccagccaatgtgactttcagatagactgcagataagctgttaccaatatctataatctcttttcccgtgagtgttttgtataggaatcttctcgtgaatgagctttagatagccaaaatgactgacaaaacatcagtagtaggtgataaataaataaaagtttaatcatatgtatgagttagtatacctgcatatatgtgtttatgagaggaatctaagagcagtgacaccccagtaacaatgaacacagcctccagattttgatttcaaaatgtcattctcctgtaagaggaaccagagctcctt

SEQ ID NO: 66926 - DNA, 481 bp, Homo sapiens
caataataaagctgactacaagttggtctattttttattaccaccatgagccagcaattctaaataatatcagtgataaagtattcatcccccaaaatattttattgaactaggttctaaacaatttctgaggttactgttgagttttaaataatacatatatgtaagcttcaaagtagcacatttgtactgtttttcttcaataatcattttactccacatggaaactaattcagggaatatcctgctatatagttggctctcagtacatatggtgtcagctcatgtgtctccagcccctgtagtactatatattattgcatttaaatgatggatttgaaataaacaatgattataccatgattgtaaagacaagaaacagaacctgaaatacttcaatttttgattctatgtggcagtttagagttttttaaaacaatttttatgtataatttatatgcaataaatgccctcaaagttc

SEQ ID NO: 66927 - DNA, 381 bp, Homo sapiens
cctcaagctgggcctcactgcctccctcacattgggggttaggccacaccttctcaagccctaagggagcaccagattctccgctggtctcacccatcaccttgcattgttatggtttaactgtgtcctcaaaactccactagactgtggactccttgagggcggaggctgagcctatccttgtacctgcggcaccggtacctggttcagtgcctgacccagaggagatgcgctgggaatatttgtcaagggaatgaatgacgtcatgaaagcgaaagataactccagctcaaagtgtgaattctcatcaaaggaatttcatgaccacacgtaaaaaatatttgttcaatatagtacttttcaataaatattcttactgaa

SEQ ID NO: 66928 - DNA, 390 bp, Homo sapiens
atgatggttctttttccatatccttaatatgtatctttcctactcatcaggtagtgatagggacaggaggtagggaaattctgggcagaagagggtgggtccccagcaaccaccccaccctcaagcctggaactgtggcccactgtgagagcatgcattcctgttttcccgctcgaatgttcccttttccaaaaccacccatggcctgccccacagccccatcctgtgcccatagaaaccccaggttccacacagcagagaagagaagagaagagaagagaagagaagagaagagaagaggagaagcagtgagatgccagagactatggttggacattgaagagaagcagcttgacttcagagggatagcttgatggtattgcttcagag

SEQ ID NO: 66929 - DNA, 2871 bp, Homo sapiens
  misc_feature (70)..(70): n is a, c, g, or t
tcggtgcggtttgttttatggtcggtaagcgtagcgccttgttgagacggcggaagcgtctaggccgcgnctgtcctcggccttcatcatcgtcatgctcctggccagcctcaacagctgctgcaacccctggatctacatgctgttcacgggccacctcttccacgaactcgtgcagcgcttcctgtgctgctccgccagctacctgaagggcagacgcctgggagagacgagtgccagcaaaaagagcaactcgtcctcctttgtcctgagccatcgcagctccagccagaggagctgctcccagccatccacggcgtgacccaccagccagggccagggctgcagcctgaggctcaggctgtgctggcataagtgctctgctcctaggtgatggcgtatgtttgtgtataaggtacctatcagtttgtatccctcccctccttggggtggcttcagtggggtggagagtggcctccatgatggaagatgataggggactcagccatcagacaacaccctggcctcctacacgtacttctaccaccctgaacccactgctgccctgggcagtgagtggcttgttttttctcctggacttgtaatttcactccagtatatttttacttcttcattctgggatattgtgaaaagcggtaaatataggattggtgaccaattgggtcaggaagtccagtgttctggacttggggtaagcagtggggttgggacctcagatgggaagggtggtgctaagatcctcctgacctcaaagtgtatttgcctttaagcgaacaaatgctggggtccttggggaccagcttgtcagagggtagccctaagagaaggggattaccttgtaagaccatctggcgcagtggacctattagaacttgggttaaaaatgtttaagaagctaatgtttaagaagcatttgggaaagaaaaagaaataaatgtatccagataggaaaagaagaagtaaaactatttgcagatgacacagttttgtatatagaaaatcctaaggaactcacacacacacacacacacacacacgcacacagctattagaactaataagcaagttccgcaaggtttcaagatacaagatcaatatacaaaaatgaattgtatttctttatactagcaacaaacaatatgaaaacgaagttaaataattccatttataataccatcagaaagaataaaataggaatcaacttaacaaaacaagtgcaagactgaaaactacaaaattggaaagaaattaaagaaggcttaaataaatggaaagacatcctgtgttcatggatcagacttagtattgttaagatggcaatactatcctaactgacatgcagattcagtgcaatccttatgaaaatcatagctggcttttttacagaaattgataagctagtcccaaaattcataaagaaatgcaagggacccagaatatccaaataagccttgaaaaagaacaaagttggtggattcacacttcctgatttcataatttacgataaaggtaatcagctcagtgtgttactggtttaaggatagacatacggagcagaataaagagtacagatatgaacacttatacttacggtcaattgatttttgacaaggttcccaagacaattcaatagagaaaggagagtcttttcaacaaatggcaccgagacaatgatatgcaagtgcaaaagaatgaggttggacctttactcacactatgtgcaaaaatcaactcaaaacgcatccaagatctaaatataagagctgaaactataaaatcttagaaagaaacataggcatagatctttgtaaccttgaattaggcagtggtttcttagatatgataccaaagacacaagcaaccaatggaaaaataggtaaattggacttaatcaagatttgaagcttttgtgattgaaaagaccctatcaagaaggtgaaaagataacctgcagaatgggagaaaatatttgcgagtcatatatatgataaggggcttgtatctggaatatataaataactcttataacacaacaataaggagaaaaataaatcaatttaaaaaatgggctaacggtttgaatagacatttctccaaagaagatatgcaaatggctactaagcacatgaaaaatactcaacattattattcattagggaaatgcaagtcaaaatcacaatgagattccagtttacaatcactaggatggctacaataaaaagatggacaagaacgagtgtcggtgaggatgtagagaaactggtagaaatttaaattgttggtgggaatgtaaatggtgcacctgctttgaaaaacagtttggcagtacctcaaaaagttaaacgtagagtgaccatatgacccaggaatgccactcctaggtatttacccaagagaaatgaaaacgtacatacacacaaaaacttgtacaccaatgttcatagcaacattatttgtaatagccaaaaagtggaaacaacccaaatgtctaccaactgatgaatgggaaataaaatgtggtctgtccacgcaatggaacattattagactctaaaaagaaatgaagtactcacacatgccacaacatggatgagccttgaaaacttgctaagtgaaagaagccaggtgcaaaagcccacatattgtctgactgcattgaaatgcaatgtctaaaatggacgaatctatatagagtgaatatagattagcgtttgccagggcctggaggctgtgagagatgaggcatgactactaagggtttggggtttctttttcgggtgatgaaaatgttctgaaattagtggtgattgtgcacgattttgagaatgtactaaaaaccaatgaacttta

SEQ ID NO: 66930 - DNA, 5022 bp, Homo sapiens
  misc_feature (137)..(137): n is a, c, g, or t
tgttaaggctctgggaccaacgctgggcgaaccagctccgctccggaggggtctgcgcggctggcctcgcccgccccctagcggacccgtgcgatagtgcagcctcagccccaggcacagcgccgcatccagacgcngtccgcgcgcgcagcctgggaggcgctcctcgctcgcctcctgtacccatccagcgaccagccaggctgcggcgaggggattccaaccgaggctccagtgagagacctcagcttagcatcacattaggtgcagccggcaggccatcccaactcgggccgggagcgcacgcgtcactggggccgtcagtcgccgtgcaacttccccggggggagtcaactttaggttcgcctgcggactcggtgcagtggaagccgctgaacatcccgaggaactggcacgctgggggctctgggcttgtggccggtagaggattcccgctcatttgcagtggctcagaggagggtggacccagcagatccgtccgtggagtctccaggagtggagccccgggcgcccctacaccctccgacacgccggatccggcccagccgcgccaagccgtaaagggctcgaaggccggggcgcaccgctgccgccagggtcatggagggcgcgctcgcagccaactggagcgccgaggcagccaacgccagcgccgcgccgccgggggccgagggcaaccgcaccgccggacccccgcggcgcaacgaggccctggcgcgcgtggaggtggcggtgctgtgtctcatcctgctcctggcgctgagcgggaacgcgtgtgtgctgctggcgctgcgcaccacacgccagaagcactcgcgcctcttcttcttcatgaagcacctaagcatcgccgacctggtggtggcagtgtttcaggtgctgccgcagttgctgtgggacatcaccttccgcttctacgggcccgacctgctgtgccgcctggtcaagtacttgcaggtggtgggcatgttcgcctccacctacctgctgctgctcatgtccctggaccgctgcctggccatctgccagccgctgcgctcgctgcgccgccgcaccgaccgcctggcagtgctcgccacgtggctcggctgcctggtggccagcgcgccgcaggtgcacatcttctctctgcgcgaggtggctgacggcgtcttcgactgctgggccgtcttcatccagccctggggacccaaggcctacatcacatggatcacgctagctgtctacatcgtgccggtcatcgtgctcgctacctgctacggccttatcagcttcaagatctggcagaacttgcggctcaagaccgctgcagcggcggcggccgaggcgccagagggcgcggcggctggcgatggggggcgcgtggccctggcgcgtgtcagcagcgtcaagctcatctccaaggccaagatccgcacggtcaagatgactttcatcatcgtgctggccttcatcgtgtgctggacgcctttcttcttcgtgcagatgtggagcgtctgggatgccaacgcgcccaaggaagcctcggccttcatcatcgtcatgctcctggccagcctcaacagctgctgcaacccctggatctacatgctgttcacgggccacctcttccacgaactcgtgcagcgcttcctgtgctgctccgccagctacctgaagggcagacgcctgggagagacgagtgccagcaaaaagagcaactcgtcctcctttgtcctgagccatcgcagctccagccagaggagctgctcccagccatccacggcgtgacccaccagccagggccagggctgcagcctgaggctcaggctgtgctggcataagtgctctgctcctaggtgatggcgtatgtttgtgtataaggtacctatcagtttgtatccctcccctccttggggtggcttcagtggggtggagagtggcctccatgatggaagatgataggggactcagccatcagacaacaccctggcctcctacacgtacttctaccaccctgaacccactgctgccctgggcagtgagtggcttgttttttctcctggacttgtaatttcactccagtatatttttacttcttcattctgggatattgtgaaaagcggtaaatataggattggtgaccaattgggtcaggaagtccagtgttctggacttggggtaagcagtggggttgggacctcagatgggaagggtggtgctaagatcctcctgacctcaaagtgtatttgcctttaagcgaacaaatgctggggtccttggggaccagcttgtcagagggtagccctaagagaaggggattaccttgtaagaccatctggcgcagtggacctattagaacttgggttaaaaatgtttaagaagctaatgtttaagaagcatttgggaaagaaaaagaaataaatgtatccagataggaaaagaagaagtaaaactatttgcagatgacacagttttgtatatagaaaatcctaaggaactcacacacacacacacacacacacacgcacacagctattagaactaataagcaagttccgcaaggtttcaagatacaagatcaatatacaaaaatgaattgtatttctttatactagcaacaaacaatatgaaaacgaagttaaataattccatttataataccatcagaaagaataaaataggaatcaacttaacaaaacaagtgcaagactgaaaactacaaaattggaaagaaattaaagaaggcttaaataaatggaaagacatcctgtgttcatggatcagacttagtattgttaagatggcaatactatcctaactgacatgcagattcagtgcaatccttatgaaaatcatagctggcttttttacagaaattgataagctagtcccaaaattcataaagaaatgcaagggacccagaatatccaaataagccttgaaaaagaacaaagttggtggattcacacttcctgatttcataatttacgataaaggtaatcagctcagtgtgttactggtttaaggatagacatacggagcagaataaagagtacagatatgaacacttatacttacggtcaattgatttttgacaaggttcccaagacaattcaatagagaaaggagagtcttttcaacaaatggcaccgagacaatgatatgcaagtgcaaaagaatgaggttggacctttactcacactatgtgcaaaaatcaactcaaaacgcatccaagatctaaatataagagctgaaactataaaatcttagaaagaaacataggcatagatctttgtaaccttgaattaggcagtggtttcttagatatgataccaaagacacaagcaaccaatggaaaaataggtaaattggacttaatcaagatttgaagcttttgtgattgaaaagaccctatcaagaaggtgaaaagataacctgcagaatgggagaaaatatttgcgagtcatatatatgataaggggcttgtatctggaatatataaataactcttataacacaacaataaggagaaaaataaatcaatttaaaaaatgggctaacggtttgaatagacatttctccaaagaagatatgcaaatggctactaagcacatgaaaaatactcaacattattattcattagggaaatgcaagtcaaaatcacaatgagattccagtttacaatcactaggatggctacaataaaaagatggacaagaacgagtgtcggtgaggatgtagagaaactggtagaaatttaaattgttggtgggaatgtaaatggtgcacctgctttgaaaaacagtttggcagtacctcaaaaagttaaacgtagagtgaccatatgacccaggaatgccactcctaggtatttacccaagagaaatgaaaacgtacatacacacaaaaacttgtacaccaatgttcatagcaacattatttgtaatagccaaaaagtggaaacaacccaaatgtctaccaactgatgaatgggaaataaaatgtggtctgtccacgcaatggaacattattagactctaaaaagaaatgaagtactcacacatgccacaacatggatgagccttgaaaacttgctaagtgaaagaagccaggtgcaaaagcccacatattgtctgactgcattgaaatgcaatgtctaaaatggacgaatctatatagagtgaatatagattagcgtttgccagggcctggaggctgtgagagatgaggcatgactactaagggtttggggtttctttttcgggtgatgaaaatgttctgaaattagtggtgattgtgcacgattttgagaatgtactaaaaaccaatgaactttaaaaaataaaaataaacaaaaaaaattcaacagatgaattcagagaaggccagcttgatggatgaattccttggaatctcttgcctctcagcacttttgtttctctatgtggctcactgcttgagagggatctcatcattttcttactcagttttactgcaagagatgatgtctctatttggcaaaaagtaacagcagtgaaaatatatccctactttgtaaaggcacaagtgatgccttgtagctgcaggttgttatgttttatttaaaatagaaattcactagaggtgtcagaggtttttcttacctagtgaacatgttctcaaatgtcctctcagccttgaggttaggacatgaccacgtctaagaaatacctttagtcactaaatacaggacactactgatcagaggtttactgtcagggactggccagctgagtgcatggtggggcaccttttaagtttccaggcacatttttgtacttactgagatacagcaggagcactctcaaaggccacagatccactctgtctctttataacacactttattcttcctccatgctgcagtagccacatagccacacacacgcgcatacacacacaatagaatgagctagcattgtctagaggttctgggagaagagaggcttgcactgaaatgtccacgttcaaagtctaagg

SEQ ID NO: 66931 - DNA, 323 bp, Homo sapiens
gacagcctgagggcatgtccaggacaaggagggagaaggaagacaaactttgcctctttagtacctcatcttgtgattcaggatgtagtacttggacaaggctgtcgctcaggaaatgatgtttaagtcagataggtctggaagtggctccagtgttaattaatgcccttttctcctttctcctgcccccaccccctcagcctcggccttcatcatcgtcatgctcctggccagcctcaacagctgctgcaacccctggatctacatgctgttcacgggccacctcttccacgaactcgtgcagcgcttcctgtgctgctccg

SEQ ID NO: 66932 - DNA, 553 bp, Homo sapiens
taatgtcattttcatgaaagacagtcatttggaagccaagagctctatctatgttttgttcaaatagccgagtaatctactatcttggcagtaattacttctgctgcatttctaatgtgaattgcatgtgagagcttatgaatacactcttttcaagtgtatgtgggttttcaaggtatgtatttgtgtttgatcctatatttcctttgttataacattctgcttttcatcactttgacagaatatttgtaaattttctggagagtgagtttgggtatatgctttgaggaatatgcttcctcattacaaaagatatggaaacataattgattactacacttgcttatcaatagtattttgattttgtttaaatgaaatgtttaagatacgtggattgctatgcattcatgttttagatttatcctctccaggcatgatttatgccattcaataattaaaataactaagttactttagaaaaagtgcctattaaacagagtactttgtttagaggacgtatatttaaataaacttatacagctaaagaaactga

SEQ ID NO: 66933 - DNA, 471 bp, Homo sapiens
gagagacttaacaatgaactttctggatgaagaggtaatgttcctcccaggtttagaggactgtggatatatgtctataggccagctcttaaaatctccagagcagattcttcaaaactgcagcaatagacgactacactaggaacagcaatactaaaaataaagaaaatattctcaatgcttgattgacagaatgtcttcctgtcaagttaagggggaatcacaatttccaaacacctctgagaagacactttgaatagcagtcacacatctgcagtcacacatctgcaatacaaactacagatcaacgccaaacacgttataaggtacttagcacttctctgatgcatcagagattaagaatgttttttccctttttcctaccaagtaaattaaaatccaccaacacccttcagctcctctcagaaaagaaaatgatgttgggggggaaaaaagtgttgttagtttaga

SEQ ID NO: 66934 - DNA, 477 bp, Homo sapiens
caaaaaccaaaccaaccaactggcaatttcccaaatgatgattctttcccataaagaatatttaaaattcccattttgctgggcattacactagggcagcagtcttcaaactttttgtcttaagaccttagtccactcttacaaacaattgagtctctctgcttttgttgatgtgagttatatctattgatatttataatattgaaattaaaattgagaaatttaaaaagttacacatgcattcatcttaataataaaaaactcattttgtgttaatatagttaacccatttctgtgaaatctaactatatttgtccaaatacaaatttgtgagaggagttgccttgttttacatttttgccactttgtcagctgaagaataagagtcataaatttgaaaaggagagctttatttctcataaagcgttgcaacctgcaggggggccattctgacaggctgggaagcatagccttcag

SEQ ID NO: 66935 - DNA, 437 bp, Homo sapiens
gtttgacatgctgctaaatgaagttgattttatgcctccttgtacctacatatctagtaggggaggtaaacaaggcagtagccagttataatatttttaggaagcaaggaaaggggattatggaaacaaaataacaattatttcttccatccagactagaaaacatatttaattttcagtcagaaagaataattttctctcttgtggaattactatgatggaaatgaattcataatttaacttttgtttgctttttatctgagtccactgcagcaaattgactcaacactttcttttgtcttcaacgggttgtagcttatgcatacacaaacatagagtcattcacatacatgtgtacatacaaaattttgaatgtgttctccgaactggtatatctcttgattgttagaataagcatctcatgtggacaggaatta

SEQ ID NO: 66936 - DNA, 957 bp, Homo sapiens
tgtaactattagttcaagaagcagagtatgatatattcaattacaatgccggaagctaagagcaagccacattacatcctcctaaatcctgccaacaaataaaatagaaaataacaataagagagatggtacttgtgacagagactgctattgtcccacaaaatctattttctcctttcagaataaccaaacccttgttatctgggcacatatcctggattaaccaataagtggtgtcttcataaggagagggaaatttggagacaaggatacacacagagaagaaagacatgtgaagacagcggcagagattgaaatgatacagctgcaagccaaagaacactcttgccagtaaccatcagaagctaggagagaggcatggaacagattctctttcagcccccaaaagaactaaccctgctgtcaccttgatgtcagacttctgccctcctgaaataccagtcgacacttagggaaaatagaaaagaacctacattgaaatattgggggctggttcccccgatactttgggaaagctattctggaagtataacagagggaggactggacaggaagaaacttgagaggttgctggaatacaggctacacatgcctccatgctaaggactacatgtgagattgaaggaggctgttctgaggcatcagcaggagaaaatacatgacttggtcaacaacttgtatagaatgaaggcaaaagactcaaagatacatctaaaatttccaagcaacctgatacaaatggtgtccctgcagagagaagatgatttacagctcaaatgttggaactggagattttaaatgagaaagaaaatgacattaagagttgactgactatatttcagtttatttttctaaagatgaatgggtcacatcaaagaaacaaatggtaaataataaagggtattgataaagttatatgaatgtacaaaaattcaa

SEQ ID NO: 66937 - DNA, 902 bp, Homo sapiens
tgtaactattagttcaagaagcagagtatgatatattcaattacaatgccggaagctaagagcaagccacattacatcctcctaaatcctgccaacaaataaaatagaaaataacaataagagagatggtacttgtgacagagactgctattgtcccacaaaatctattttctcctttcagaataaccaaacccttgttatctgggcacatatcctggattaaccaataagtggtgtcttcataaggagagggaaatttggagacaaggatacacacagagaagaaagacatgtgaagacagcggcagagattgaaatgatacagctgcaagccaaagaacactcttgccagtaaccatcagaagctaggagagaggcatggaacagattctctttcagcccccaaaagaactaaccctgctgtcaccttgatgtcagacttctgccctcctgaaatgtaagaataaatttcttgttttaagccgttctgtctgtggtagtttgttatggccaccctagaaaaggaacgcatgtgatatcgaagtctttccactggacagttccaacctccctttggccctccattcatgctcagtcgataaccttgcttttgaggaagtagaagccatcagacggtaacttcctcaacttctggacaaggacaggtgaagtggaagagatggaactgatgacaaagatgcagaactaagtagccaaagctctcagattctacgctgggacactagtttcctgggaaattcctaggatgaccagcgtgaagaggaagatgaggcagttgttaacaaacaagatgtgagcaaaaagagtaatgaaaaaaggaagatggctttagccagtcagcaggtatcagtttcaaaggtagtttttaaaaaataacagag

SEQ ID NO: 66938 - DNA, 530 bp, Homo sapiens
  misc_feature (469)..(469): n is a, c, g, or t
tgtaactattagttcaagaagcagagtatgatatattcaattacaatgccggaagctaagagcaagccacattacatcctcctaaatcctgccaacaaataaaatagaaaataacaataagagagatggtacttgtgacagagactgctattgtcccacaaaatctattttctcctttcagaataaccaaacccttgttatctgggcacatatcctggattaaccaataagtggtgtcttcataaggagagggaaatttggagacaaggatacacacagagaagaaagacatgtgaagacagcggcagagattgaaatgatacagctgcaagccaaagaacactcttgccagtaaccatcagaagctaggagagaggcatggaacagattctctttcagcccccaaaagaactaaccctgctgtcaccttgatgtcagacttctgccctcctgaaatgtaagaataaanccggatgcggccgaaaaccataatatatataataataacagggagactgtgaaaataaaaa

SEQ ID NO: 66939 - DNA, 1195 bp, Homo sapiens
  misc_feature (26)..(27): n is a, c, g, or t
gactactactactaaattcgcggccnntcagactccttttagaaaatgggatgatcctggctcttactgtgaaatattgcaagatgaagtccttcctgctgatggctctcccagtgagagtacatttcttgtttgtcttttttttctttttcttgtcaattcttgggtgggagaaaagccttctaatatttcctcatccaaaaactcatagtctgagatttttgcagttaattttatcatgattagtctagaatacgactgcctttcattttgcattcaccttcttcgtctaataatgattaatgccttctgtcagttttttctctttgccattatgaatggaaaatgaaaaattgtgaattcccatcggtgttcagtgaaagctaaaagtagacaacaggtatgatgtcttgaaagatgatgatgaaatactttggacaatacaatgagaaaactaatatcttaaaaactatttagttatttttagcatagttgagaataatgaattataaataatgaattataaataatgaactattaaaaactattaaaaaacaacagtttttacatttgtttcaaaatgtagggaaaaaatacgctcactaggattccatcatatttcttagatttataagagttcagtggactcatttgataattgcaagatagcatgagttttagtctgttcttttaaaaaataagttttctctttgttctttggaagacttttaagaaagaataaaagtaatgacatctcaatcctaacaagtaactagaactgctaaaaaaaaaaagcagaatttttaacttcaactaacaactgtggctgccatctaagttcagagtactaggtgctctaggaccctaccctgcgaggcagtgggtctcaaagtgtggtccccagataaatagcatcagcaatcatttaagaatttgttgaaattcaaatcctagagctccaccccagacccgctgaatctctggggctgtagccctgcagtctgttttaacaagccctctaggtgacgctgatagaggcaaacttttgagactcagctctggctgtaggagaactaaaggattctgctgtgaggtaatagaaaaggagtaaatttgaatgtgatgaatatgcttaacttcctaagcaagaaaaatgaacgctgtttatagttacaactgacaggggaaaaaaact

SEQ ID NO: 66940 - DNA, 342 bp, Homo sapiens
atgcctagttatgttataggcactggggatacaataatggaacaaaatacctaagtctgtgccattatggagcttacattctggtatggagagttagacaattagtgaaatataatccttaaggaggttatagattctatagagaaaaatgaagtaggggccaggcacagtggctcatgcctgtaatcccagtgttttgggagactgaagcaggcagatcacttgaggccaggagttcaagatcagcctggccaacatagtgaaacccgtctctactaaaaatacgaaaatcagccgagtgtggtggtgctcacctgtaatcccagctacttagaaggctga

SEQ ID NO: 66941 - DNA, 333 bp, Homo sapiens
ccaatgcaaaactgcttaccaccttggcatcttggcacaacctagtccctctgcctagaatgcccttcctattacccaccttcacttggctaacaccaggtcatctttttgatctcagctgaaatgctgcatgtgaataaggcttccttgcctctccaggctaagtcaggtttttctaatacgtggcctgctggcattctggatttctctatctcagctctcatcaaaattgcaattaattattactatatttccttgactttctgatatgtgtatatgtttctaaacacctaacatctctgaagttgggatgcatcttataattgaaggcat

SEQ ID NO: 66942 - DNA, 491 bp, Homo sapiens
tggaaaagctgtaactctcatacattactggtaataacataaaatagtgcaaccactatggaaaatagtttggcagtttcttaatgacctagcaactgcactcttgcatttatgtgagagaagtgacaatatgtccaactcaaaagatttacattcaaacattcaaagcggctttactcagccccaaagtggaaacaacatatatttctaagaacaagaaaatggatttaaaaactttgctatatgcatgaaatggaacattactaaccaatttaaaaagtactaatacaacagacatggggatgaatctcaataccattattctgagcaaaaggatgtctctctcaatatttgcccttggaactcagctgccatgctatgaggaagccttttcacagagagaagtcacatgaagtgtaagccaaagttcccaggtaaagtctctcagtcaacagccagcatcaatggccagatgtgagttagtgagcctt

SEQ ID NO: 66943 - DNA, 589 bp, Homo sapiens
ggtttaaagcaaacgcatgccagtttagcagccctctcatttaggcaccaaacacaagaaagcacctgctgtcatccgctgggaatccccggtcccaggcccctgtattctgtattgggatggcccatgaagactgacctgcccacaccagccagtttgggaggggccaggggagtactggactctgtgtcaaccagcagagcatctcaaaaacaaatattcagtcactattacagtcttggcacttttccctctaaagcacaagtcagtgctggttaacatagcctgggtcacttaatgctttcctatctccaccagtcaccacaaaccatgtcatgaggcccagtgaggcccccttacacattgtgggactagcacaggggcagcttgggatactaggtcataggggacagtggagagacatagaacagtgtccaaggggctttcgtccataatgatggagttttgcttttaaacactgttctaaacatttaaaatgtaccttttcctgtcatttagtttatgataaaggcattgcagcttttccattggatttgctcattatttaagtcttttataaatccaggaa

SEQ ID NO: 66944 - DNA, 312 bp, Homo sapiens
catcctcataaaaagggagcaggaaaaccaaagggttgaaactacagctacccgagaagaggagatgaataaaaagtatgagtcccagaacattatctctactcagctgaggtccattttcccagtctgtctcctgagaacatgacatgaatagtctgcccacccaggctactttctatactaatgaagggtcccagggcctggctaaatcccgtcagggtgaactgaggtttgtctgctgcagcttcagatttctgcaccaagcccaactctaactcattcaataaatatcatttaggtatctattctatt

SEQ ID NO: 66945 - DNA, 541 bp, Homo sapiens
gagaaaccccatctctactaaaaatacaaaattagccaggtgtggtgttgcatgcctgtaatcccagctattagggaggctgaggcaggagaatcgcttgaacccgggaggcagaggttgcagtgagtcgagatcacaccattgcactccagcctgggcaataagagcaaaactccgtctcaaaaataataataataataatttaactgtgttctgcacacacagaattacaaaatccctataggactttcacagatagctttgggcttaaggtcttcggacaacaggtagttctaatttcttactctttgggacatttagtacatgttggtacacataaggaaagaaaatggcttatattagagctaggaaacaggggcagcctggatttttatggtaggaactcactctgtgcttttttttttttctgttaagttttcttgacactgacttcggtaacattggctaaagggaattgtgagtcatgtgaatttcacctgcagtgcagactttaaaggactgtgttcattctgatttgggg

SEQ ID NO: 66946 - DNA, 487 bp, Homo sapiens
gagaaaccccatctctactaaaaatacaaaattagccaggtgtggtgttgcatgcctgtaatcccagctattagggaggctgaggcaggagaatcgcttgaacccgggaggcagaggttgcagtgagtcgagatcacaccattgcactccagcctgggcaataagagcaaaactccgtctcaaaaataataataataataatttaactgtgttctgcacacacagaattacaaaatccctataggactttcacagatagctttgggcttaaggtcttcggacaacaggtagttctaatttcttactctttgggacatttagtacatgttggtacacataaggaaaggaactcactctgtgcttttttttttttctgttaagttttcttgacactgacttcggtaacattggctaaagggaattgtgagtcatgtgaatttcacctgcagtgcagactttaaaggactgtgttcattctgatttgggg

SEQ ID NO: 66947 - DNA, 176 bp, Homo sapiens
gttaaatctagatggacatgatttcataaaatggtctaatgtcaggtttaaattaagtatgcttgtgatgctcaaatagttaactaaaaaataaatttaaagaaaaaaggcattagaaaatagaagagaaggaaataagaacttataacaatgaaaaaaagaatttaaaatattgg

SEQ ID NO: 66948 - DNA, 725 bp, Homo sapiens
ctaaattctcatgtctgttactgattctgtctgttgtgatctgttgttttcattgaagaggttaggaaagaaaggtattttagaagcattttcagataattgtgggtattcttctttcatacatattatagcaaaacttcagtgttgcatgtggaatctgaaaccatattgacagagtctgttacagtaatacccatttgtctattttatcttttacttgatgccacaattctacgacattatttggaaaaatcccaattcactaaatcatgcagctcttccaatgttgacatatttcatcctatagtattaaaaaatcgtatttgttcatatctgtattgatcttagttgaaaagtattttaagtaggaagctgtcagacttgtggtggcagatacaagttttccaaaattctaattttcacttgaaagcttgaattctatcacatgcaacaaataatgtcagtggttttccccagagtggcagcctcactttgttaattttcaaaaatgtctgccaaatacccaggtctgagtaactgaccgtggtttgtcactcaagtttcctttcaagtaaaaatggtgtccttgaaaaaaatgacttgattagcttgcaactcaaacagtaatatgcttttttttttttttttggcaataaccattgtacttcagtatgcagaagggctttaagtgtacttagtatttcatcacacagtgcattaaaaag

SEQ ID NO: 66949 - DNA, 601 bp, Homo sapiens
  misc_feature (4)..(4): n is a, c, g, or t
  misc_feature (45)..(45): n is a, c, g, or t
gtgncctaggccagacccgggaaggtattggcttgattggattgncggggtgttgctaatccaaatgtcctattccggcctgggtatagccttagagtatttcttaacacatgattcctggatgtcgctcctttttgctcccaactggagcaaaactgtaaaaacagcaacttgttctagatctggaggcaaaattggttccagcagacccactgggaagtgggaggtgtttgctatgctttgtggacaatttaagtgtttaaaaggcaattttgatgagccatgattttcatcttaagtgccaactttagaagataaccttcatataaaagtttctctacagtttgtattttaaaatataaaatggaagaaaaaactatcaccagctttgcttttttcctcttggttaatggactatctattaacgtctcactaaatggccaaatggagtctcacagtacacagtttgggaaatgctgccttaagttgctctgtgaagccttaagttcgtgtaaccatgacttagccatctgtgaaatgggtagacccatggggcataggaattggggaatgtattttgcatcaagtaggactggtgtgg

SEQ ID NO: 66950 - DNA, 370 bp, Homo sapiens
cattgacaaggcgctaaggccttccattctatcttgtaaagtgtgtagtctctaaaaaaaaaaatgttaaaagtttttatctgtacaaaagtatccagagaagaccatgcttcctctttgatttgacagaaactaatcatgttgagctatttaagaaacacagaatactccaaagaaattagttttaacatccttcttgttataaggtgataaaaacaaatctttgtgatttcccagggacctttaggaacctccagagatagtttagatgtaaaaaacagagttgcatactacttagcaatggaaaaggataaattactggctgatacatgtaacgatgtggattaatctcaaaactattatgctgcat

SEQ ID NO: 66951 - DNA, 300 bp, Homo sapiens
taatacatttaagaaaacagatttatgcgtgctcacaaatctgacaatatgaaggctatattaatataaccagtacttacattatcccatttaagtaaagtctttggattttagatgtgcagctaggccctgctttatttaaaagcttaaaaaattatggctaaaatggttttttgtacaacacctttcttttgccccttgtaactttatgagttagtaataaatgagtttggttacgtcaaaacaaatgggaaatagtttgagttttaatgcaatattttaaaacctggtaaaaattcc

SEQ ID NO: 66952 - DNA, 528 bp, Homo sapiens
tccctcattaacctacccctgcccttgctaaacttaataataaatgctggtatatcccagtgcattgttggcaccatgggaccagaaggtggtgacccccctggacccagctttcactatccttgtgtgtgtctgttatttctcaacctgctgaatccgcctgggaacaaagagccccgttgcattgcgggctactggccagatcccgcaatactctgctgtttaaaattgtagctgtttcaatcataaagaaactggcatttattatgcatatgattttttcaccttgttcttgttactaagtcaattatgataagcttaaggtttatgttgtgaataatcactaatcagttgcacttttgaaggtatgtcactatcaaaatggttttgtagagctagagttgaaaatgctgtatctattgtatgctttccataaattcattgcttatgtaaagttttgtcctgttgtgactatgctgttgaactattaattaaaacattttgaaaagcatcttggaaagttatatt

SEQ ID NO: 66953 - DNA, 2439 bp, Homo sapiens
cttgtcttacaatttttaattgtttaaaagaaggtttgatatataaaaacaagaaaaggagcagctttgagagttaaaaaagccgaggctgaaatgatgcattacaaagtatatagattctgtactccagataagatggggtttagagggagtggtagaaacatttgctccttaatggcaaaggtaataaactcctgctctcactgcaagaattgaccatgagatggggtcaggaatcttcaggggagcagacagtggtgtggcccttgtctaggtctccatttatacctgaagatggagcggaatacgcactccagatgcctggaacaccattgcatgggagtgtgggtcacggatccgagggatacacactctagatgactggaagtcaatagcctgggaagcgcaggtcacaccccgagggaaagggcttcaggatgaacatctgcagaaggcgtggacaaggatgggaggcaacagggtcactgggctttccaggactcagagaatcaaaaggcttccaggtcatttctggtagagctgttggtggttacaggaagcaatttggatcccagactcctggagatgaacagctttacggtgagctcagctctgagtgtggaagcactgccatcccaggggcttctgtcgcagaagaaacggaaatctggcaaaaggatggccaggctggccagaaaccactggtctagatagaaaaggaatatgctactgttgccagccaaggctttgtttgttttggggaaaaaatattgctctgagtgaaatatctatttctggcatctattaacaattggttatggttccttgttttaattatatcattacatttttaaaatgaaggatttaatttgcttttgctcctatttgttgctgatgtcgctcagttctccaaatggctgctgtcttcctctagtacttagtctgccatctagaagcaaattaaagacacccaagaaacttcagttattgtattggtaactataaaataatgattaacaaacagaaggacaggaagcgggagaaggcagtcaagtaggaagtagaaaatctaacactgagagagcaccccccaacatagggactgtgtggaggttttacccaaatgatgcttcatttaattttcaccaaaagaaagtgaggtccttccccatctgagggacaggcctctgacacccatctccgtagcagtcatcccacaggttggccatggctgagtaggtcagggacagacaccttctcgaagctgggctatcgtcctctcactctttgatttggaattcagtctttatcattgaagggttagaactgtaatagacaaacaattgggaattaagaggctgccagatcctgttatatggagtaacaaaataggacattagatggatagatggagagagacagaaagagagatggatagatggatggattgagagatgatagataacagatagaggacaggaaagaggagagaaagaaagaaagggcacgagaaaaagaaaaagagagagagccacgtacagagagaaatgtgcatgggaagcagagccccggttccagtttcttcctgtagttcccctgcattcctattccttggttccatgagacaccccaagtccttacaacaaactctcattctaagctaaaagtttgtttctgttgcctgcacacaaagactcctaactaataaaacagtgaacaaaatgactgatatctgtaatagggtaacctgataacacttttaagattgattagattgagaccaaacagaagggaaaacacctaggcaccgtgaagacctatacagtcattaacattctcctgacttagaacctgtgataattagggagtgacctgcagcagtttccttcactctgtgagccatgcatgcaaatgaggggtgcaggagaggaatgcagacctggggcccacccgcattcaagtgcaattgatggggccattgcaggtcaccctgatctgcccagtgcccctagctgctgctggtagacttgtaggatcctataatttaggcttctcattaattcagatgaaccgtgactttggtgtgcccttctccattccagttatgtggaagaaatttcatctcttggtcttttatgcattttaagatttgatagcaacgctagtggctcatgcctgtaatccagcactttgggaggccgaggtgggcagatcacaaggtcaggagatcgagaccatcctggccaacatggtgaaacactgtctctactaaaaatacaaaaaaaaaaaaaattagctggcgtggtggcacgtacctgtaatctcagctactcaggaggctgaggcaggagaatcgcttgaaccagggagtcggagattgcagtgagctgagatcgcaccactgcattgcagcctggtgacagagtgagactccatctc

SEQ ID NO: 66954 - DNA, 4300 bp, Homo sapiens
  misc_feature (3564)..(3564): n is a, c, g, or t
  misc_feature (3580)..(3580): n is a, c, g, or t
  misc_feature (3598)..(3598): n is a, c, g, or t
  misc_feature (3632)..(3632): n is a, c, g, or t
  misc_feature (3637)..(3637): n is a, c, g, or t
  misc_feature (3671)..(3672): n is a, c, g, or t
  misc_feature (3713)..(3713): n is a, c, g, or t
  misc_feature (3835)..(3835): n is a, c, g, or t
  misc_feature (3864)..(3864): n is a, c, g, or t
gcttccagaacaggaggcagagcctttccgcagtttccctgcccacagcacacaccctgtgccctccgccccctggttcttggacactggggacatctggatgcggctagagcctgtgggggtggccgcagccctgggggactgttcccaggagtaggcctcggggccacaggggcgcggcctcgggcctggcactgcaacctcagggtgagcgcccttcgtgtgtgcggcaggagccggggcccctggctgtcagcaggcccccgagtccaggtaggtcccagacagcagtcccgggtgtggcagatgcagtgaggtccacttctgaggcgttccctggagtctgtgagttctggtcggaccttcgatggcattttaatgtgtctcttgtgtttgatttttagtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtaccaccacgtggtcgcctggggctggcagaaccgcacgttggggggagttggagggacgggagcacggcaggcccgggccacagcaggtctgggtgccactggggcaggagcagcctctgtcccagtcgtcccgcgccgtcaggaggtggacacggggttttccctggacaccatcaggaggtggacatcgggtttgccctgagccccatcaggaggtggacacggggttttccctgtgccccatcaggaggtggacaccacgtttgtcctgagccccatcaggaggtggacattcggtttgccctgtgccccatcaggaggtggacacggggttttccctgagccccatcaggaggtggacactcgttttgccctgtgccccatcaggaggtggacacggggtttgtcctgagccccatcaggaggtggacacagggttttccctgagccccatcaggaggtggacacggggtttgtcctgagccccatcaggaggtggacacggggtttgtcctgagccccatcaggaggtggacacggggtttgtcctgagccccatcaggaggtgaacaccgggttttccctgagccccatcaggaggtggacacggggtttgtcctgagccccatcaggaggtggacacggggtttgtcctaagccccatcaggaggtggacacggggttttccctgcacaccatcaggaggtggacacggggtttgtcctgagccccatcaggaggtggacacggggttttccctgcacaccatcaggaggtgaacaccgggttttcactgagccccatcaggaggtggacacggggtttgtcctgagccccatcaggaggtggacacggggttttccctgagccccatcaggaggtggacatggggttttccctgagccccatcaggaggtggacactcggtttgtcctgagccccatcaggaggtggacaccgggttttccctgagccccatgaggaggtggacactcggtttgtcctgagccccatcaggaggtggacactcggtttgccctgtgctccatcaggaggtggacactcggtttatcctgagccccatcaggaggtggacactcggtttgccctgtgccccatcaggaggtggacactcggtttctcctgagcctcatcaggaggtggacacggggttttccctgagccccacactcggtttgtcctgagcgccatcaggaggtggacactgggtttgccctgtgccccatcaggagatggacgctcggtttctcctgagccccatcaggaggtggacacggggtttgccctgagccccatcaggaggtggacaccgggtttgccctgagccccatcaggaggtggacattcggtttgccctgagccccctcaggaggtggacaccgggtttgtcctgagccccatcaggaggtggacattcggtttgccctgagccccatcaggaggtggacaccgggtttgtcctgagccccatcaggaggtggacacttggtttgccctgtgccccatcaggaggtggacacttggtttgccctgtgccccatcaggaggtggacaccgggtttgccctgagccccatcaggaggtggacaccgggtttgccctgagccccatcaggaggtggacacggggtttgtcctgagccccatcaggaggtggacactcggtttgtcctgagccccatcaggaggtggacaccgggtttgccctgtggcttcttgattcattttcagttttttcccagagagcaggtcctcgggatgccagcttttgtggcgggggtggagtaaggtgcttcccccggccccagttgcgcggcggtcttcacacgggcggtctcggcattgcccgcggcctggctttggtccagcagtgagcagcctttgggcagctttcctgattcttgtttgctcaggagacccacaggctcctccgtgatgagaactaggttggtctggcttctacttgtagccagggatcagtgattcagagcagcttttccctgaagacagacgaagaagctgggcccccaggagctcacaggatagggccaggcccaggctgcagcctggagaggcctagaacctgcaggaacgggcgggccttgccaactctggcctggggtgttggctgttctggaagaagtagctgagaggctgaatttggctttggtggcatcactggcctgctgggtgtggggccctgccgggatatccatggcctgaaaggtgacatctggagtgagggtgacctggactctgacgcgccacacgatcggcacccagcctgctgatgtccaggaaaccttgaatctggatttttggggaccccacactgccggccccaggtgcctggcaaaagaagtaagacggcccctttagaggaagacagcgtcagccgaggcctcgggtcatttctacaaatcaccatctggtgcggggtccatcacatgcaaacagaggtaaccaggcagtcaaggagatgcgcaaaacgcagaagccagggaagcagtgccacccgcaggagctccccgtgctgcccacgagccgatcaccccagcccagcccccaggaggctgggccagacaccgacgaagagctgatgactctggaacggggcgtagcagcgttaggggagaaaatgagatgcggatctgagaaaacggcgaagctgatcggtggaactgaggggcgggtttaccagctgaccaggcggcagcggacaggagggaaggagagaacgcgggagagggcgagatgagaagggtcgtcttgcagaacttcagacangagagggaagggttgnaagtgtgatgacagcaanccctttccaaaatgacggaagaaaatctgatgtnaaaantgcgcgtgtctgccgggagcgtctgctgggcgtnngctctgaagattcttcacggtttctcacacgggtagatgcntgctgtaatgcagcccagtgccacactcctttatcccggagactcggaatgcgcgtccacacacagacctgcacgtcatgctccctagcagcttaactcaccatagcccaaaccagaaggangccccccaccggctgtccttcagtgggtnagtgccaggcaaatgctggccacctccctcggtgtcctcctcagcaacaggcatgaacgctgggtccctgccacaccctgggtgatctcggcagcatgatggcgagtgaagaagctggtttcaaggggtgcacactgtatgatctcttcatccccaggtgataggattagcgtgacggaaacagtggcccggggtgtaggtgggggggccgcgcaggccggtgtctggaatcggcacatgggcacgttggcacgtcacgtgggcatgtccacacgcatgcaaggggctgtgggtgaactgcccgtggtgcacacctgagggagttgtgtggcaccagctcggtttggacagtgccctttgttaggtacggttttctcattgggaagctggatttgtattaaagatgcacacgtaagaataaaaaagaggctcgtag

SEQ ID NO: 66955 - DNA, 630 bp, Homo sapiens
ggatcgacgaactgatgaaggaggaccgagctgggcagtggtggtgtcttgatcgggcatgtggaggggcaggtcaggtccctcccagctgtgctttgtgacacgtcaggccggtgcgtgatctcctgttttggcttctggccaggccactagcacccatccgaaaaccatcctcatgattgcatcctgccgtcagcttccctactgacctggctgctgagtctgcttgtgagcagctctcggttcaaggctgcagccctcgcttctgttgggcaggtgcctgtaggtgcagaagcaggccaccagctccatgcaggccactggccctcccctgcctggtacccaggcaggtctgctcaggggcgcagtggtcatgtcccagagccatgtgctctttgctgctttgtcctacctgctgccccgttcctcgcccaaaacaggctcctcccctgctaccttgtcctaggtgctccccaacccaaccagccagacgctgttcataccccttttgttacttctgagctgccctgtcccctgccatcaccttaattctcatcacttggacagctgcagtaaccacccagcaggtctccctgccttttctcagtgccaccaacaagaccctgatac

SEQ ID NO: 66956 - DNA, 354 bp, Homo sapiens
cccatccgaaaaccatcctcatgattgcatcctgccgtcagcttccctactgacctggctgctgagtctgcttgtgagcagctctcggttcaaggctgcagccctcgcttctgttgggcaggtgcctgtaggtgcagaagcaggccaccagctccatgcaggccactggccctcccctgcctggtacccaggcaggtctgctcaggggcgcagtggtcatgtcccagagccatgtgctctttgctgctttgtcctacctgctgccccgttcctcgcccaaaacaggctcctcccctgctacccttgcacaagcaccgaggacaagccctagactccacctcatccaagcaggag

SEQ ID NO: 66957 - DNA, 538 bp, Homo sapiens
tgacttcttgctgcattcttacataatggaagaggtaaacaagctttcttgggcctcttttataagaacactagtcctattcataagggctccaccctcatgatctagtcacctcctcaaggcctcacctcttaacgctgtcgcattggaaattaagtttcaacatacaaatttgtggcagggaaggaggacacaaacattcagaccgtaacaatccccaagtatttttatgctattataaatggaatttttttaagttttctaattgttcactgttagtctacagaaatataaattttgtttattgaccttgtgtcttaccattttgcattcacttattagttctagtaactttttgtagattctttaaaattttctatgtacaaaatcgttttatatgtaaacaaatagaattttacttcttttccagtttatatgttttttattactttttttgtatattacattggtgaagactccagtgaaatattgagtaactccgtaaaaagtagatatctttccctcatttttgatctta

SEQ ID NO: 66958 - DNA, 442 bp, Homo sapiens
ccggaattcccgggtcgactactactactaaatcgcggcgcgtcgactctagatgcttctctatttcttttttctttcattttttttctccctatcatcttgtattaaagatgcttcttaaagttgatttgtaatttccttaggattctgactgtggcatatcaattttacctttcaagagtgagagctaggctgggcatggtggtggcttatgctggtaatcccagcactttgggaggccaaggcaggagcccaggagttcaaaaccagcctgggcaacacagtgagagcccatctctacaaaaaaagaaaaaaaattagccaggcgtagtggcatgtgcctatggtcctaggtacttgggaggctaaagtacttgagcccagtagtttgaggctacactctagcctgggtgacagagtgataccctgtctcaaaaaaaaa

SEQ ID NO: 66959 - DNA, 352 bp, Homo sapiens
ccttgaatcaaagtcagagaagtcccatgtcttccaggaatagacctgtcttagtatccctgccggccttaactatttgctaggagcagcctgtataggaagcatgcctgggtgcaaatgcagataggtctcagtacagcaatggagcccttaggccattttgttccctgtggctggaggtgtgtgaggcacattctcctggccaccataggagccagaacaaagaccaggatgggtgtgacacagcctgatttaaatgccagtctgcgtctttaataacaggtctgacttgtaaagtaatacaagctgctgctcaggatggcactgctttcaggagtgtcttttgagtcag

SEQ ID NO: 66960 - DNA, 554 bp, Homo sapiens
agcacatctaggtactggggcccagggtgactctgagtggctcaagtcccctggccagatcctctccagatgggcccctggccatcttagccaacatcacctgattctgtttcctctgactctgtcctcaaaaggcagcatctgattgtgatttggtccagaaattcctggccagaatatttccagtgtggtgcatgtgaacttcccgccttcccttccttccctcctccctcctttcttcactggggagaaagaatttggcattcgagtatctcaccccgtcttgctaagcagtttagttagactgcaggccagtctctgtggtgtgaccaccccccagtggcaaggagctgccaaaactgagcttctgggcaagacgtgggcagagcaaagagagacccacacttggcacttcctgcccagaaaggacctgctcaggcctggctggcctttaccaccgtcatctccaggctttctgttcatccgtactttcaaagatttagtgatcaagtactatgtgtcaggaaccatgctcagcactcgataaaacagac

SEQ ID NO: 66961 - DNA, 528 bp, Homo sapiens
ccagcaatactgagcctatattctagcttagtaacaattggctggagctaaatgatgggccacagaccttcctgtttgtcagtctccattgaatacatatgctcttgcttcctgcctggaccgtggaaggtcttgcagtacaaaatagagatttgaggcattttggagttaagacaggccttccctggagtcctgttactatctcttaatagttatgtgccacagagtgatacactttaacttctgggcccagtgttctcatgtatgtagtcatacctacctttctaggttgtggtgaggtttaaacaaatacatatgaagtgctcagtattacctattacctggcatcaaaaaaagtgttcaataaaatgtacgtatcacatatgatcagttgagtttgttattgggctagattatataagtaaacgttgtcagttgaaagcctatggagtactcttatatatatttatatttttaatagatatattatagttatatatctgaggagtactcaattctcacaaaaaa

SEQ ID NO: 66962 - DNA, 424 bp, Homo sapiens
aaaaaagtgcccccaaagaccattgaacctctcattgtgaaacagaagctcatgagttttaaatagagaagaagtcaggaggggcctctgaacagtttgttctccaagcagccgagcacaccttcactaaggagaaccacattctaggatttagcattcttcttgaattacttatctcagatccaaaagttcaacttgctgaaggctttgatgtgtttatgcctaaaacttcactgtactctatattgtcaaactacactcgcacagaaagccttttgtttagaaaatggtgtgtgcattttttataacgactttggctaactccttacccaatagtaagagaaaaaaaggacttgatgacaaccaaaaaggactagaccaaaatactgtgtgtacaataaaagtgagaagtgttacagcattc

SEQ ID NO: 66963 - DNA, 2393 bp, Homo sapiens
ggcctaaggctgggggccgacggcggcggcagcagggagctgggaagcggagaagccgggagcgcggggctcagtcggggggcggcggcggcggcggctccggggatggcggcggctccgctgctgctgctgctgctgctcgtgcccgtgccgctgctgccgctgctggcccaagggcccggaggggcgctgggaaaccggcatgcggtgtactggaacagctccaaccagcacctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagcaaatcgaagcgtgggaggcacccccattgctctcctccaggggcagaacatggggaggggactagatgggcaaggggcagcactgcctgctgcttccttcccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccaggctaggccccccacacctgggggaccccctggcccctcttttgtcttctgtgaagacaggacctatgcaacgcacagacacttttggagaccgtaaaacaacagcgccccctcccttccagccctgagccgggaaccatctcccaggaccttgccctgctcaccctatgtggtcccacctatcctcctgggcctttttcaagtgctttggctgtgactttcatactctgctcttagtctaaaaaaaataaactggagataaaaataaaaaaaaaaaaaaaaaaaaaaaaaaaaaaaaaaaaaaaaaaaaaaaaaaaaaaaaaagaaacaaacaccacaaaacaacaaagaaaaaaaaaacaacaggggcggcgccgcgcgcggcaacaagacccccacgggggggcggccgcaatagcaccgccgccgccccgcttttgacggagggaggcgcacccacagagaagcgcgaccaacatataacaacaaccgaacacgacggggcccgaccaccaaacagcacacggaacacagcagggaggaacacaacgacgacagcaccagagcagcacaccacgacgcgcacaacgaccaccaccacacacgaacgcgggccgagcgcacacaacacgtggggcaaacaaccccgcccaagacggcggaacgacccgcccccgccagtcgaggccacccagccaccgcaccagataacagagcggcgacaacacggacgcaggcaccaccacacctaccgcccaaaagcagacgccagagaggacacgagagaaattgagagacaacacaggagggcccatactgcccagccaacatctacaacaggaca

SEQ ID NO: 66964 - DNA, 1974 bp, Homo sapiens
cgcggctgagaccagggaggaggcgtgggcacgggacgcctgaggggttcagctcagacgaggtcgtggggccaagagaggagtttggtgacagtcccaagtttgggctgcggagaatcgctgtttctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagcaaatcgaagcgtgggaggcacccccattgctctcctccaggggcagaacatggggaggggactagatgggcaaggggcagcactgcctgctgcttccttcccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccaggctaggccccccacacctgggggaccccctggcccctcttttgtcttctgtgaagacaggacctatgcaacgcacagacacttttggagaccgtaaaacaacagcgccccctcccttccagccctgagccgggaaccatctcccaggaccttgccctgctcaccctatgtggtcccacctatcctcctgggcctttttcaagtgctttggctgtgactttcatactctgctcttagtctaaaaaaaataaactggagataaaaataaaaaaaaaaaaaaaaaaaaaaaaaaaaaaaaaaaaaaaaaaaaaaaaaaaaaaaaaagaaacaaacaccacaaaacaacaaagaaaaaaaaaacaacaggggcggcgccgcgcgcggcaacaagacccccacgggggggcggccgcaatagcaccgccgccgccccgcttttgacggagggaggcgcacccacagagaagcgcgaccaacatataacaacaaccgaacacgacggggcccgaccaccaaacagcacacggaacacagcagggaggaacacaacgacgacagcaccagagcagcacaccacgacgcgcacaacgaccaccaccacacacgaacgcgggccgagcgcacacaacacgtggggcaaacaaccccgcccaagacggcggaacgacccgcccccgccagtcgaggccacccagccaccgcaccagataacagagcggcgacaacacggacgcaggcaccaccacacctaccgcccaaaagcagacgccagagaggacacgagagaaattgagagacaacacaggagggcccatactgcccagccaacatctacaacaggaca

SEQ ID NO: 66965 - DNA, 2256 bp, Homo sapiens
gggggcagagacagggctgagccgcgaggaagctcggaggaaaagtcggaaggctacgcggaccctggggaggggctgcggagcggtcagatggaaagcggctttgctctggggtttcttctctctgagccgcttcctcttccccacagcctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagcaaatcgaagcgtgggaggcacccccattgctctcctccaggggcagaacatggggaggggactagatgggcaaggggcagcactgcctgctgcttccttcccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccaggctaggccccccacacctgggggaccccctggcccctcttttgtcttctgtgaagacaggacctatgcaacgcacagacacttttggagaccgtaaaacaacagcgccccctcccttccagccctgagccgggaaccatctcccaggaccttgccctgctcaccctatgtggtcccacctatcctcctgggcctttttcaagtgctttggctgtgactttcatactctgctcttagtctaaaaaaaataaactggagataaaaataaaaaaaaaaaaaaaaaaaaaaaaaaaaaaaaaaaaaaaaaaaaaaaaaaaaaaaaaagaaacaaacaccacaaaacaacaaagaaaaaaaaaacaacaggggcggcgccgcgcgcggcaacaagacccccacgggggggcggccgcaatagcaccgccgccgccccgcttttgacggagggaggcgcacccacagagaagcgcgaccaacatataacaacaaccgaacacgacggggcccgaccaccaaacagcacacggaacacagcagggaggaacacaacgacgacagcaccagagcagcacaccacgacgcgcacaacgaccaccaccacacacgaacgcgggccgagcgcacacaacacgtggggcaaacaaccccgcccaagacggcggaacgacccgcccccgccagtcgaggccacccagccaccgcaccagataacagagcggcgacaacacggacgcaggcaccaccacacctaccgcccaaaagcagacgccagagaggacacgagagaaattgagagacaacacaggagggcccatactgcccagccaacatctacaacaggaca

SEQ ID NO: 66966 - DNA, 1896 bp, Homo sapiens
cgcggctgagaccagggaggaggcgtgggcacgggacgcctgaggggttcagctcagacgaggtcgtggggccaagagaggagtttggtgacagtcccaagtttgggctgcggagaatcgctgtttctccacgcccactcacaacctgcactggaagtgtctgaggatgaaggtgttcgtctgctgcgcctccaaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagcaaatcgaagcgtgggaggcacccccattgctctcctccaggggcagaacatggggaggggactagatgggcaaggggcagcactgcctgctgcttccttcccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccaggctaggccccccacacctgggggaccccctggcccctcttttgtcttctgtgaagacaggacctatgcaacgcacagacacttttggagaccgtaaaacaacagcgccccctcccttccagccctgagccgggaaccatctcccaggaccttgccctgctcaccctatgtggtcccacctatcctcctgggcctttttcaagtgctttggctgtgactttcatactctgctcttagtctaaaaaaaataaactggagataaaaataaaaaaaaaaaaaaaaaaaaaaaaaaaaaaaaaaaaaaaaaaaaaaaaaaaaaaaaaagaaacaaacaccacaaaacaacaaagaaaaaaaaaacaacaggggcggcgccgcgcgcggcaacaagacccccacgggggggcggccgcaatagcaccgccgccgccccgcttttgacggagggaggcgcacccacagagaagcgcgaccaacatataacaacaaccgaacacgacggggcccgaccaccaaacagcacacggaacacagcagggaggaacacaacgacgacagcaccagagcagcacaccacgacgcgcacaacgaccaccaccacacacgaacgcgggccgagcgcacacaacacgtggggcaaacaaccccgcccaagacggcggaacgacccgcccccgccagtcgaggccacccagccaccgcaccagataacagagcggcgacaacacggacgcaggcaccaccacacctaccgcccaaaagcagacgccagagaggacacgagagaaattgagagacaacacaggagggcccatactgcccagccaacatctacaacaggaca

SEQ ID NO: 66967 - DNA, 850 bp, Homo sapiens
  misc_feature (27)..(27): n is a, c, g, or t
cccgagaatcgtgccactgcactcgancctgggtgatggcccctcttttgtcttctgtgaagacaggacctatgcaacgcacagacacttttggagaccgtaaaacaacagcgccccctcccttccagccctgagccgggaaccatctcccaggaccttgccctgctcaccctatgtggtcccacctatcctcctgggcctttttcaagtgctttggctgtgactttcatactctgctcttagtctaaaaaaaataaactggagataaaaataaaaaaaaaaaaaaaaaaaaaaaaaaaaaaaaaaaaaaaaaaaaaaaaaaaaaaaaaagaaacaaacaccacaaaacaacaaagaaaaaaaaaacaacaggggcggcgccgcgcgcggcaacaagacccccacgggggggcggccgcaatagcaccgccgccgccccgcttttgacggagggaggcgcacccacagagaagcgcgaccaacatataacaacaaccgaacacgacggggcccgaccaccaaacagcacacggaacacagcagggaggaacacaacgacgacagcaccagagcagcacaccacgacgcgcacaacgaccaccaccacacacgaacgcgggccgagcgcacacaacacgtggggcaaacaaccccgcccaagacggcggaacgacccgcccccgccagtcgaggccacccagccaccgcaccagataacagagcggcgacaacacggacgcaggcaccaccacacctaccgcccaaaagcagacgccagagaggacacgagagaaattgagagacaacacaggagggcccatactgcccagccaacatctacaacaggaca

SEQ ID NO: 66968 - DNA, 2007 bp, Homo sapiens
ggcctaaggctgggggccgacggcggcggcagcagggagctgggaagcggagaagccgggagcgcggggctcagtcggggggcggcggcggcggcggctccggggatggcggcggctccgctgctgctgctgctgctgctcgtgcccgtgccgctgctgccgctgctggcccaagggcccggaggggcgctgggaaaccggcatgcggtgtactggaacagctccaaccagcacctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagcaaatcgaagcgtgggaggcacccccattgctctcctccaggggcagaacatggggaggggactagatgggcaaggggcagcactgcctgctgcttccttcccctgtttacagcaataagcacgtcctcctcccccactcccacttccaggattgtggtttggattgaaaccaagtttacaatgctttggctgtgactttcatactctgctcttagtctaaaaaaaataaactggagataaaaataaaaaaaaaaaaaaaaaaaaaaaaaaaaaaaaaaaaaaaaaaaaaaaaaaaaaaaaaagaaacaaacaccacaaaacaacaaagaaaaaaaaaacaacaggggcggcgccgcgcgcggcaacaagacccccacgggggggcggccgcaatagcaccgccgccgccccgcttttgacggagggaggcgcacccacagagaagcgcgaccaacatataacaacaaccgaacacgacggggcccgaccaccaaacagcacacggaacacagcagggaggaacacaacgacgacagcaccagagcagcacaccacgacgcgcacaacgaccaccaccacacacgaacgcgggccgagcgcacacaacacgtggggcaaacaaccccgcccaagacggcggaacgacccgcccccgccagtcgaggccacccagccaccgcaccagataacagagcggcgacaacacggacgcaggcaccaccacacctaccgcccaaaagcagacgccagagaggacacgagagaaattgagagacaacacaggagggcccatactgcccagccaacatctacaacaggaca

SEQ ID NO: 66969 - DNA, 2309 bp, Homo sapiens
gggggcagagacagggctgagccgcgaggaagctcggaggaaaagtcggaaggctacgcggaccctggggaggggctgcggagcggtcagatggaaagcggctttgctctggggtttcttctctctgagccgcttcctcttccccacagcctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagcaaatcgaagcgtgggaggcacccccattgctctcctccaggggcagaacatggggaggggactagatgggcaaggggcagcactgcctgctgcttccttcccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccaggctaggccccccacacctgggggaccccctggcccctcttttgtcttctgtgaagacaggacctatgcaacgcacagacacttttggagaccgtaaaacaacagcgccccctcccttccagccctgagccgggaaccatctcccaggaccttgccctgctcaccctatgtggtcccacctatcctcctgggcctttttcaagtgctttggctgtgactttcatactctgctcttagtctaaaaaaaataaactggagataaaaataaaaaaaaaaaaaaaaaaaaaaaaaaaaaaaaaaaaaaaaaaaaaaaaaaaaaaaaaagaaacaaacaccacaaaacaacaaagaaaaaaaaaacaacaggggcggcgccgcgcgcggcaacaagacccccacgggggggcggccgcaatagcaccgccgccgccccgcttttgacggagggaggcgcacccacagagaagcgcgaccaacatataacaacaaccgaacacgacggggcccgaccaccaaacagcacacggaacacagcagggaggaacacaacgacgacagcaccagagcagcacaccacgacgcgcacaacgaccaccaccacacacgaacgcgggccgagcgcacacaacacgtggggcaaacaaccccgcccaagacggcggaacgacccgcccccgccagtcgaggccacccagccaccgcaccagataacagagcggcgacaacacggacgcaggcaccaccacacctaccgcccaaaagcagacgccagagaggacacgagagaaattgagagacaacacaggagggcccatactgcccagccaacatctacaacaggaca

SEQ ID NO: 66970 - DNA, 413 bp, Homo sapiens
gatacctatttctgtttttagtaaacaaagcttattgaaaaagtcttttttgtatttgctaagaatgtttttcattaacaatggctattttctaatattggagtacactgatgcttccatgggtcattgatgtcagcaaagcttgcttgcctaggcattcttatttgtataaattattctgatggtaatccggctatttccaaacacagtgatctcttccgagttcatcctcattctttgtagctggctccttctttatggccaaatcacttggctctgggtggttttgtttctattgcttctcaaacttccattctaatttgaatttgcatttgtaaaatcactgcccaaatttctgatcgtaatctagcaagcgtgtaaagacaataaaaacaaaagaagttgcataattt

SEQ ID NO: 66971 - DNA, 1122 bp, Homo sapiens
gttccctctcactcatggagaggctttcaaaaagatcttataaatccccaaaatgtaataactcctaaagcctctttgtaatttcccaattctacctcatgtcttttactgtggtacaaaagggctaagatgacgagtttctgataatgtctttttttttgtagagactgggatcctttgaaaatccaacatgtgtaccaccacttacaggtttaagtttgtgctctgcaaactcatttgaggagtaatagatagagttaggcttgtagagatcagtttacctgtcaaatggatgggctttatgagaggagttataaatctagaaagaagaagtaaaagccaatacactgatctttgatcactcaaaccatttttcccaagggcagggactaaacaggggtttccagtcttttggcttccctggggcacattggaagaagaagaattgtcttgggccacacataaaataaactaacattaatgatagctgatgagctaaaaaaaaaaaaaaaaaaaagttgtaaaaaaaaaatctcataatgttttaagaaagtttacaaatttgtgttaggccacattcaaagccatcctgagccacaggttggacaagcttggactagcagaaggtgacagataatggtttttacatgagacctcattataatcaatatcaggtctcaatatggttataagattataatcttcatgtgtcaattccatctctttattttgataggtcaatgcttttaaaaaatagtaaactcttaaaattattattaggaaataagctttgtgtaatttttctggtatagtgaaagattatactcattcattcacattctttcctaagctcataattccttgtacttgcaagacggctaagtaagaatagaaatttggtttgtgggataatataatttaagttatagcaaaattctgaaacatctctagagtggtatataggttttcagtgtttccatatccatctaccacccctgtggggctggggaagggttgttgactgggactggactctcagtcttctgggtctgatgtgctcttgacctgataccattccaaagcttactctttgtagaaggaataaattcagggctttcttct

SEQ ID NO: 66972 - DNA, 944 bp, Homo sapiens
gcggtcgctcataaagggtgcagcatttacaggtttaagtttgtgctctgcaaactcatttgaggagtaatagatagagttaggcttgtagagatcagtttacctgtcaaatggatgggctttatgagaggagttataaatctagaaagaagaagtaaaagccaatacactgatctttgatcactcaaaccatttttcccaagggcagggactaaacaggggtttccagtcttttggcttccctggggcacattggaagaagaagaattgtcttgggccacacataaaataaactaacattaatgatagctgatgagctaaaaaaaaaaaaaaaaaaaagttgtaaaaaaaaaatctcataatgttttaagaaagtttacaaatttgtgttaggccacattcaaagccatcctgagccacaggttggacaagcttggactagcagaaggtgacagataatggtttttacatgagacctcattataatcaatatcaggtctcaatatggttataagattataatcttcatgtgtcaattccatctctttattttgataggtcaatgcttttaaaaaatagtaaactcttaaaattattattaggaaataagctttgtgtaatttttctggtatagtgaaagattatactcattcattcacattctttcctaagctcataattccttgtacttgcaagacggctaagtaagaatagaaatttggtttgtgggataatataatttaagttatagcaaaattctgaaacatctctagagtggtatataggttttcagtgtttccatatccatctaccacccctgtggggctggggaagggttgttgactgggactggactctcagtcttctgggtctgatgtgctcttgacctgataccattccaaagcttactctttgtagaaggaataaattcagggctttcttct

SEQ ID NO: 66973 - DNA, 466 bp, Homo sapiens
tgtcttcgagcacttgagcgtttgctccccattgtccaattttggtgaagcaaagccactgtttcccttttggacatgtagccccattatgactgccagatactcctagattttttactttataataactctttcctgattcaacacattcctcgactaaggttccacaataggatctttctatatgactatggtgagtgaaggactgttgacatgagtatggtgagtgaaggattgttgcatctttcctctgtggtggaaagactgataacactcacagcagctctgaagggctgctgtgggcagcagggcggctactgaccgtataaggatcgtggtgagggatattcccgtattaagacttttggttggaagtgaggcacagcatcggattgggtagatacaggccatctctggaagcaggtgtttagtcttcctcgtgttttggttttaagaaaaagaaaat

SEQ ID NO: 66974 - DNA, 805 bp, Homo sapiens
tggccgcggagggggcgaactgggttccggccctcggaggctgacggaaggcggtggctgaggagcggcgcctctggttgagcgctcgccgtgtgtcccgcacctgtctgtcctgccgccgcccggtaagagtctcactctgttgccaaggctggagtgcagtggcgggatctcggctaactgcaacctccccatcccgggttcaagcgattctcctgcctcagcctcccgagtagctgcgattacagacatttgccaccatgcccggcacagcacagcaccgcacatctccagtcggactggctacatttcaagggctcaaccatcacgcgttaccagtggctactgcatcagactgtgcagtgctagatggggagtcagaagagaaaccaagtgatttccatgtcaagtggtgaacaggctaagaagaaaaacagagtctcgctgcatcccccaggctggagtacagtggtatgatcttggctcactgcaacctctgcctcctaggttcaagtgattctcctgcctcagtctcccgagtagctgggattacaggcgcccaccaccatgcccggctaatttttgtatttttagtagagatggggtttcactatgttggccaggctggtctcaaactcctgacctcaggtgatctgcctgacttggcctcccaaagtgctgggattacaggcatgagccaccttgcctggcctcttcctaatgattttttaaagtacatcttgttttctctgtcttactttatcataaaaatatatgatacaaataaaatacagaatatgtgtta

SEQ ID NO: 66975 - DNA, 1826 bp, Homo sapiens
gagacagattctcactcagttgcccaggctggagtgcagtggtgcagtcttggctcactgcaacctctgcctcctgggttaaagcgattctcatgcctcagcctccctagtagctgagactacaggcgtgcaccaccacgcccagctaatttttgtatttttagtagagacaggatttcaccatgttcaccatgttggtcaggctggtcttgaactcctggcctcaagtgatctgcccgcctcgacctcccagagtgctgggattataggtgtgagccactaagcctggctgagacaactagtttcccttaactcattggaattctctaggattaggagaattccacagagcctatatgatattatagctcaacatttagtataccaaaggcatacccgtgtaaatctaggagttatttccagagattgttttaaggagcagtcttatattcagggtagaaagttatgattggatctgctgttaaggagaacaaaggagcttctaaaggtttgggaggtttactggtagtaactattctaggaaatatttatgttttaaggtgatgttcacatgggttctttagaaggaacatagtcaagtgtgatggattaactctatatagtctttctcctcttgtgcgtgtaggaaatctgacctgcagtgtcagttgatgtgacaagagataaagaaagcacagtattttaaaatctaaagcagattcctttcttagaaaacaataggaaaaaattatagatggatgtctttgctgaaatctaacaattagctcatattccatgagaaagagtggcctaagaattatttcatgttacctagccttctgaagctactcacttgatgtgcctagcactttgaaactaaccttttctttctttgttcatgacagtttaattccaaatatttactattttctcttgtaactgttagaacagttccttttgacattaatttttgcctacatatatatttttaagttgagaccaaatcggtgaagtgttgagcaagtaacatttatgatgtgtgtatattggaacaaatgtaaaagggttacaaagattagaaacagagtcataaaaaatggcttgatttataaaggcattacttttggtgctttatataatggcatatattgaactaaaaatttgtatatacagtatgtcagcatttcttagtaacttctcttgaatccatttttaatatctaatattgtacaggttggggagttacattcttcaggccaatactatccagactatataaatttataaaataaattgaaaaattcattcccctgtattcaagaccaaagcacataaatgctaatgtagggctcagaggggaaatacagttctcctgcatatttgagaaaatgtgaagtcctttcaagaaaatctaataaacataataatcatagcctgctgacactaaggaaaaaggacctcattcactctttcttttatgcagtgatttactggtccctactgatttccaaattggatcacgatagtaaattatccatgctggtacctgtgaaagtaagccctgggatccatatttgttttgtgttctgcttaaatcagcaagaatgataaatttgatggtgtgaaattggaagtatcaagggctttctttggtgattgagggaaataatgtctctacttgtaatttattgtgaccctttttcactgtatatgctttgtatgtctaatatttatttcaatgcaaattcaattgttccttcatctgtattgttatatctaagattttattgatgttaaaatctaattgtggaataaaaatctctctg

SEQ ID NO: 66976 - DNA, 2085 bp, Homo sapiens
gagacagattctcactcagttgcccaggctggagtgcagtggtgcagtcttggctcactgcaacctctgcctcctgggttaaagcgattctcatgcctcagcctccctagtagctgagactacaggcgtgcaccaccacgcccagctaatttttgtatttttagtagagacaggatttcaccatgttcaccatgttggtcaggctggtcttgaactcctggcctcaagtgatctgcccgcctcgacctcccagagtgctgggattataggtgtgagccactaagcctggctgagacaactagtttcccttaactcattggaattctctaggattaggagaattccacagagcctatatgatattatagctcaacatttagtataccaaaggcatacccgtgtaaatctaggagttatttccagagattgttttaaggagcagtcttatattcagggtagaaagttatgattggatctgctgttaaggagaacaaaggagcttctaaaggtttgggaggtttactggtagtaactattctaggaaatatttatgttttaaggtgatgttcacatgggttctttagaaggaacatagtcaagtgtgatggattaactctatatagtctttctcctcttgtgcgtgtaggaaatctgacctgcagtgtcagttgatgtgacaagagataaagaaagcacagtattttaaaatctaaagcagattcctttcttagaaaacaataggaaaaaattatagatggatgtctttgctgaaatctaacaattagctcatattccatgagaaagagtggcctaagaattatttcatgttacctagccttctgaagctactcacttgatgtgcctagcactttgaaactaaccttttctttctttgttcatgacagtttaattccaaatatttactattttctcttgtaactgttagaacagttccttttgacattaatttttgcctacatatatatttttaagttgagaccaaatcggtgaagtgttgagcaagtaacatttatgatgtgtgtatattggaacaaatgtaaaagggttacaaagattagaaacagagtcataaaaaatggcttgatttataaaggcattacttttggtgctttatataatggcatatattgaactaaaaatttgtatatacagtatgtcagcatttcttagtaacttctcttgaatccatttttaatatctaatattgtacaggttggggagttacattcttcaggccaatactatccagactatataaatttataaaataaattgaaaaattcattcccctgtattcaagaccaaagcacataaatgctaatgtagggctcagaggggaaatacagttctcctgcatatttgagaaaatgtgaagtcctttcaagaaaatctaataaacataataatcatagcctgctgacactaaggaaaaaggacctcattcactctttcttttatgcagtgatttactggtccctactgatttccaaattggatcacgatagtaaattatccatgctggtacctgtgaaagtaagccctgggatccatatttgttttgtgttctgcttaaatcagcaagaatgataaatttgatggtgtgaaattggaagtatcaagggctttctttggtgattgagggaaataatgtctctacttgtaatttattgtgaccctttttcactgtatatgctttgtatgtctaatatttatttcaatgcaaattcaattgttccttcatctgtattgttatatctaagattttattgatgttaaaatctaattgtggaataaaaatctctctggaatttagcagatacaaaaatgttatcttgcaaaagaactaagaacatttgtagttagaaatcagctttcctttgagcttaattgcctttttgttagaataaggtgaatttgaacacactcctcttatcctcagcccatcacaaataatagagatgccatgattttgaggtctgatgtgaaactggtaaaaatgtgatctaaggtgtaactggaaaaaaaaaggaaagaaaaattacattgatgcctcagctgtttgct

SEQ ID NO: 66977 - DNA, 1494 bp, Homo sapiens
gagacagattctcactcagttgcccaggctggagtgcagtggtgcagtcttggctcactgcaacctctgcctcctgggttaaagcgattctcatgcctcagcctccctagtagctgagactacaggcgtgcaccaccacgcccagctaatttttgtatttttagtagagacaggatttcaccatgttcaccatgttggtcaggctggtcttgaactcctggcctcaagtgatctgcccgcctcgacctcccagagtgctgggattataggtgtgagccactaagcctggctgagacaactagtttcccttaactcattggaattctctaggattaggagaattccacagagcctatatgatattatagctcaacatttagtataccaaaggcatacccgtgtaaatctaggagttatttccagagattgttttaaggagcagtcttatattcagggtagaaagttatgattggatctgctgttaaggagaacaaaggagcttctaaaggtttgggaggtttactggtagtaactattctaggaaatatttatgttttaaggtgatgttcacatgggttctttagaaggaacatagtcaagtgtgatggattaactctatatagtctttctcctcttgtgcgtgtaggaaatctgacctgcagtgtcagttgatgtgacaagagataaagaaagcacagtattttaaaatctaaagcagattcctttcttagaaaacaataggaaaaaattatagatggatgtctttgctgaaatctaacaattagctcatattccatgagaaagagtggcctaagaattatttcatgttacctagccttctgaagctactcacttgatgtgcctagcactttgaaactaaccttttctttctttgttcatgacagtttaattccaaatatttactattttctcttgtaactgttagaacagttccttttgacattaatttttgcctacatatatatttttaagttgagaccaaatcggtgaagtgttgagcaagtaacatttatgatgtgtgtatattggaacaaatgtacacacaggggttaccaacagacttcagaaaaccaggagctccataaccaccacactggccgtttgtcatatctaccacaccgcgcccactcactctatgagatggcctctcactacttaattgggccattagtactttggaaacctacacaccactattcggtactactcagcaacgtcacttgttccaagccaattttacctttaaacctcacaacttttcctcccttatgacacattacccaaattcttattcacataacttcctacaacattaatttgtctacaccaaaggccttggcaagcacaagctctcaccgctttatccctttcaccacggatcacacaacttcacagtcaaatcccaaggcacacctcacattactcacacaccttatccgttcacacacacctctcagcactctctgcacacac

SEQ ID NO: 66978 - DNA, 892 bp, Homo sapiens
gagacagattctcactcagttgcccaggctggagtgcagtggtgcagtcttggctcactgcaacctctgcctcctgggttaaagcgattctcatgcctcagcctccctagtagctgagactacaggcgtgcaccaccacgcccagctaatttttgtatttttagtagagacaggatttcaccatgttcaccatgttggtcaggctggtcttgaactcctggcctcaagtgatctgcccgcctcgacctcccagagtgctgggattataggtgtgagccactaagcctggctgagacaactagtttcccttaactcattggaattctctaggattaggagaattccacagagcctatatgatattatagctcaacatttagtataccaaaggcatacccgtgtaaatctaggagttatttccagagattgttttaaggagcagtcttatattcagggtagaaagttatgattggatctgctgttaaggagaacaaaggagcttctaaaggtttgggaggtttactggtagtaactattctaggaaatatttatgttttaaggtgatgttcacatgggttctttagaaggaacatagtcaagtgtgatggattaactctatatagtctttctcctcttgtgcgtgtaggaaatctgacctgcagtgtcagttgatgtgacaagagataaagaaagcacagtattttaaaatctaaagcagattcctttcttagaaaacaataggaaaaaattcttaggccactctttctcatggaatatgagctaattgttagatttcagcaaagacatccatctataattttttcctattgttttctaagaaaggaatctgctttagattttagtcgacgcggccgcgaatttagtagtagta

SEQ ID NO: 66979 - DNA, 620 bp, Homo sapiens
gagacagattctcactcagttgcccaggctggagtgcagtggtgcagtcttggctcactgcaacctctgcctcctgggttaaagcgattctcatgcctcagcctccctagtagctgagactacaggcgtgcaccaccacgcccagctaatttttgtatttttagtagagacaggatttcaccatgttcaccatgttggtcaggctggtcttgaactcctggcctcaagtgatctgcccgcctcgacctcccagagtgctgggattataggtgtgagccactaagcctggctgagacaactagtttcccttaactcattggaattctctaggattaggagaattccacagagcctatatgatattatagctcaacatttagtataccaaaggcatacccgtgtaaatctaggagttatttccagagattgttttaaggagcagtcttatattcagggtagaaagttatgattggatctgctgttaaggagaacaaaggagcttctaaaggtttgggaggctgaggcaggagaatggcgtgaacccgggaggcggagcttgcagtgagccgagatcgcgccactgcactccagcctgggcgacagagcgaggctccgtctca

SEQ ID NO: 66980 - DNA, 1573 bp, Homo sapiens
ccagcgcgttaatagctatagatgtcgaataccaaggggtggacaaataatccctttccctcattggaattctctaggattaggagaattccacagagcctatatgatattatagctcaacatttagtataccaaaggcatacccgtgtaaatctaggagttatttccagagattgttttaaggagcagtcttatattcagggtagaaagttatgattggatctgctgttaaggagaacaaaggagcttctaaaggtttgggaggtttactggtagtaactattctaggaaatatttatgttttaaggtgatgttcacatgggttctttagaaggaacatagtcaagtgtgatggattaactctatatagtctttctcctcttgtgcgtgtaggaaatctgacctgcagtgtcagttgatgtgacaagagataaagaaagcacagtattttaaaatctaaagcagattcctttcttagaaaacaataggaaaaaattatagatggatgtctttgctgaaatctaacaattagctcatattccatgagaaagagtggcctaagaattatttcatgttacctagccttctgaagctactcacttgatgtgcctagcactttgaaactaaccttttctttctttgttcatgacagtttaattccaaatatttactattttctcttgtaactgttagaacagttccttttgacattaatttttgcctacatatatatttttaagttgagaccaaatcggtgaagtgttgagcaagtaacatttatgatgtgtgtatattggaacaaatgtaaaagggttacaaagattagaaacagagtcataaaaaatggcttgatttataaaggcattacttttggtgctttatataatggcatatattgaactaaaaatttgtatatacagtatgtcagcatttcttagtaacttctcttgaatccatttttaatatctaatattgtacaggttggggagttacattcttcaggccaatactatccagactatataaatttataaaataaattgaaaaattcattcccctgtattcaagaccaaagcacataaatgctaatgtagggctcagaggggaaatacagttctcctgcatatttgagaaaatgtgaagtcctttcaagaaaatctaataaacataataatcatagcctgctgacactaaggaaaaaggacctcattcactctttcttttatgcagtgatttactggtccctactgatttccaaattggatcacgatagtaaattatccatgctggtacctgtgaaagtaagccctgggatccatatttgttttgtgttctgcttaaatcagcaagaatgataaatttgatggtgtgaaattggaagtatcaagggctttctttggtgattgagggaaataatgtctctacttgtaatttattgtgaccctttttcactgtatatgctttgtatgtctaatatttatttcaatgcaaattcaattgttccttcatctgtattgttatatctaagattttattgatgttaaaatctaattgtggaataaaaatctctctg

SEQ ID NO: 66981 - DNA, 1802 bp, Homo sapiens
tgctgggattacaggcatgagccacagtgccggacattatgggaaaattttttgagggactaaactaatctccacaaatagcaatgcatttaggaaatatatttaaaggggaaaaaaagactcatagtttcactcagtcatgttcataatttttagtatttgggttttttagcatgtaatttgtgtacatagttttggtttttgtaaacttgcataggggttttctggtacaaactggaaaacctgctagacaaattctgaaacatctgtaatgcttgtaggtagttgttgtaacactatgcccacacataatcactttccatattgctgcatagtctttgtaaccatttttcttcttcttttttttgagatggagttttgctcttgttgcccaggctggagtgcaatggcgcgatcttggcccactgcaacctctgcctcccgggttcaagctattctgctgccttagcctcccgagtagctgggattgcaggcacacgccaccacgcccggctagttttgtgtttttggtagagacggggtttcaccatgtcagccaggcttttcttgaacttctgatctcaagtgatcctcactcctcagcctcccaaattgctgggattacaggcgtgagccaccacgcccacctgtaaccattatttttaagattgctaccattggatagttctgtcatggtccaacttttggatatttaaaattgatccctgtgtggctaacagaattaatgtttccaaaaatgttgaaaattatatagttctcttaattccccacctctaactatatttttgggttatttctttaggaacagatgcccaggagtcatattactgagaatctagaaatcttttgcaaagttcttgttatattgccaaattgcttcccaaaagggttgttctaaaccataatttcaccagcaatgtaggggagaaccatttttatgctgcccttgtgagaattgggtatgaaaacatttttaaaatgatttttgatgaggtgaaaataatatttgaatatattttaatttgcctttcccccacttatagtgagcttaaacattttttccttttcctagctgtatttctccctttgttattcgttcttttgtccatttatctactggggagatggggagtgttatctttttagtttatcagttatttgcattttaaatataaccatttgccatattttaacaacgatttttccattaaataattctttttataaaaaaactttatatatctgttgatgttttgtgatttttattgcttctaagctaatacagatttttggatcttaaaaaaaaaaaaaaaaaaaaaaaaaaaaaacaaaaaaaaaaaaaaaagaaaagagagagaagaaaagacacaacaaaaaaaacaaaaaaaaaagaagaaaacaaagaagaacaagaaaaacaagaaagagaaaggagcacaaagaagagagacacaaaaaaagaagagggaacaaaaatataaaaaaaaaaaaaaggagagaacagaaggaagatagagagcagaaacaacataaaaaagaagaaaaaaaaagaaacgtggggggaggagaaatcgtcgagagagagactagggacgaaactccacacaagagaaaaaaaagaagaaaaacacaaagagagaacagcgagacaagaaacggaaagcaacaagcaggcagcacaaacataacaaggagagcacaccaaacaaatcaagagaagagaaaataaaaaaacacaagggacagaaactacacaacataaacaggacacagggggacac

SEQ ID NO: 66982 - DNA, 270 bp, Homo sapiens
ataaccatttgccatattttaacaacgatttttccattaaataattctttttataaaaaaactttatatatctgttgatgttttgtgatttttattgcttctaagctaatacagatttttggatcttattcaatttcgctttcttctgtttaggttattatctggttttatacctaactacttattttcaaattgctaaccagttatcctaatagtatttactgaattccttcccactcctacatcacatattaaaattattttatgcct

SEQ ID NO: 66983 - DNA, 2607 bp, Homo sapiens
  misc_feature (2)..(2): n is a, c, g, or t
  misc_feature (8)..(8): n is a, c, g, or t
  misc_feature (2351)..(2351): n is a, c, g, or t
cnacgcgnggagccggcgcagggtggccggggaggggtgagcagggtgccgctggctgctggggtctgcaggtcaccgagtccccaggagaggggactcctaagaagccacctgcctgtgtttacccggcagcgagcgcgcaggcccccgcgaactcctggcagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgttcctgaacccaacctcaacgaggtaatatttgaggaatcaacttgccagaatttggttaaaatgctggagaactgtctgtccaaatcaaagcaaactaaacttggttgctcaaaggtccttgtccctgagaaactgacccagagaattgctcaagatgtcctgcggctttcctcaacggagccctgcggcttgcgaggttgtgttatgcacgtgaacttggaaattgaaaatgtatgtaaaaagctggataggattgtgtgtgattctagcgtcgtacctacttttgagcttacacttgtgtttaagcaggagaactgctcatggactagcttcagggactttttctttagtagaggtcgcttctcctctggtttcaggagaactctgatcctcagctcaggatttcgacttgttaagaaaaaactttactcactgattggaacaacagtgattgaagggtcctaaaaagggaaaatatataaagattatttcatgattgggtagtaaaactattcagctagtcagctaaagtcatttgtagtttgccccacctgccctaaataagaaaccccaaatgtagtctcttttctttctgtgtttcacattcatagcaactgcagctaacaggctgattttctggccttggagaagtgattcaaaatagtgtagattttctgcatagatcccatttttgtacagaattgaatgggatggaataggtaagcaaaagtagaagcccatttgagttttacatttgattccacaattggtttcaggtaggcttggtaatagactatataaaccagatttgcctattttgattttcatatggcttttttttctgtaagttttcagaggattttttaaatcacagaatcatactaaatgatatttagcctatcaaaacttccaaaagcccacaccaccagttcctgactcaaatttgaagggtttttagacaggagggtaggattaagtaggtgagtttaattaaagcttaaccctaggtaagagtaaatgagaaatattacggcaataatggaactgcttcactgtttcttggtgacttcctcactctaatgttttaaagaggcaacaaaagcttgtggtgccatttcagtaaccacggtgttgttttagatgcctttataagctcagtttcccctgttcttaagtgttgaatactgtctttaaactagaaaaatgcaaaatattgaactgatatttttgtgtgtagttgattactcttccattgagtgaatgatgaatacctgtgaggataggaaattagttctgagatctagtccctctctgattcacttagtaatctatcctcttttcagtattacatgtgcttaatctcagatgaaccatttcaccatggcagtgttatctcatctctgggcttttctgggaattgaagtatctctccttaaccccaattgtcaagggtagtagctgtatactaccactttgaattattgaaacgggtcaatttacgaagtctgcattggctatggagatatggtttatagtacagcctagagaatgaaactcaccgtccagataaccatgcatgcacccagattttttccaccttggatacctgtcactagggaataataaaggccttattttttgtcttattccaactaagtagatcattatctctttccttttttatgttaatgagagaatttagcctccactcaacaatgttcaattcagcaaggctttcatatccttgctgtgggtcgtggataaggagcttattcaggtttcctgccctagctattagctccacttcacatgctggagaccggcgtagggacagatgtattcatcctggtgttactgaaaaacaggtgtgatcctgttactgatactataagtgacctaaaatgtcactgttcaaattagccagtgttctaacaaactaaactcttcaaatgcttggaaagatactacaaagccaatctttatagaattgggccaagataaatctatgttgttttgcatgnctattgttaagctccaaaggttcactgtgtttctgccgctgtcctggagttgtcaccactgactgggcaaggcttcttgggcatcgatgtagaactgttgtcctttttccactaacagttatctttgactctcttgcctgttatgcttacaaaatggtgatggcttatggaaggctgttaaattaatattcctgttaaaggaaattaaagtttgtctatttttgacaataaaacattatatatttttaaaaaaatt

SEQ ID NO: 66984 - DNA, 2877 bp, Homo sapiens
  misc_feature (2)..(2): n is a, c, g, or t
  misc_feature (8)..(8): n is a, c, g, or t
  misc_feature (2621)..(2621): n is a, c, g, or t
cnacgcgnggagccggcgcagggtggccggggaggggtgagcagggtgccgctggctgctggggtctgcaggtcaccgagtccccaggagaggggactcctaagaagccacctgcctgtgtttacccggcagcgagcgcgcaggcccccgcgaactcctggcaggtgagcgaagctgcggccttggtgggggcagcggggccggggggcgctccgcggggcaggtcgcttccaagttttgcgaactgttgagttagtttcaggttgcggctccgctcccagggctttgtcaaattgagttgcagaggccggttccacccctttggcaaaggagttcctccgctagttcgctcccgggacgccgggcattttaggagcctctgcacgactcgcctgcttttgcaaatccgtctcttctcgcctcattttttccagcgctcaggaaaggccgttgcgcctcgcgaaggaaacagagccgttgaccatggttgcaactggcagtttgagcagcaagaacccggccagcatttcagaattgctggactgtggctatcacccagagagcctgctaagtgattttgactactgggattatgttgttcctgaacccaacctcaacgaggtaatatttgaggaatcaacttgccagaatttggttaaaatgctggagaactgtctgtccaaatcaaagcaaactaaacttggttgctcaaaggtccttgtccctgagaaactgacccagagaattgctcaagatgtcctgcggctttcctcaacggagccctgcggcttgcgaggttgtgttatgcacgtgaacttggaaattgaaaatgtatgtaaaaagctggataggattgtgtgtgattctagcgtcgtacctacttttgagcttacacttgtgtttaagcaggagaactgctcatggactagcttcagggactttttctttagtagaggtcgcttctcctctggtttcaggagaactctgatcctcagctcaggatttcgacttgttaagaaaaaactttactcactgattggaacaacagtgattgaagggtcctaaaaagggaaaatatataaagattatttcatgattgggtagtaaaactattcagctagtcagctaaagtcatttgtagtttgccccacctgccctaaataagaaaccccaaatgtagtctcttttctttctgtgtttcacattcatagcaactgcagctaacaggctgattttctggccttggagaagtgattcaaaatagtgtagattttctgcatagatcccatttttgtacagaattgaatgggatggaataggtaagcaaaagtagaagcccatttgagttttacatttgattccacaattggtttcaggtaggcttggtaatagactatataaaccagatttgcctattttgattttcatatggcttttttttctgtaagttttcagaggattttttaaatcacagaatcatactaaatgatatttagcctatcaaaacttccaaaagcccacaccaccagttcctgactcaaatttgaagggtttttagacaggagggtaggattaagtaggtgagtttaattaaagcttaaccctaggtaagagtaaatgagaaatattacggcaataatggaactgcttcactgtttcttggtgacttcctcactctaatgttttaaagaggcaacaaaagcttgtggtgccatttcagtaaccacggtgttgttttagatgcctttataagctcagtttcccctgttcttaagtgttgaatactgtctttaaactagaaaaatgcaaaatattgaactgatatttttgtgtgtagttgattactcttccattgagtgaatgatgaatacctgtgaggataggaaattagttctgagatctagtccctctctgattcacttagtaatctatcctcttttcagtattacatgtgcttaatctcagatgaaccatttcaccatggcagtgttatctcatctctgggcttttctgggaattgaagtatctctccttaaccccaattgtcaagggtagtagctgtatactaccactttgaattattgaaacgggtcaatttacgaagtctgcattggctatggagatatggtttatagtacagcctagagaatgaaactcaccgtccagataaccatgcatgcacccagattttttccaccttggatacctgtcactagggaataataaaggccttattttttgtcttattccaactaagtagatcattatctctttccttttttatgttaatgagagaatttagcctccactcaacaatgttcaattcagcaaggctttcatatccttgctgtgggtcgtggataaggagcttattcaggtttcctgccctagctattagctccacttcacatgctggagaccggcgtagggacagatgtattcatcctggtgttactgaaaaacaggtgtgatcctgttactgatactataagtgacctaaaatgtcactgttcaaattagccagtgttctaacaaactaaactcttcaaatgcttggaaagatactacaaagccaatctttatagaattgggccaagataaatctatgttgttttgcatgnctattgttaagctccaaaggttcactgtgtttctgccgctgtcctggagttgtcaccactgactgggcaaggcttcttgggcatcgatgtagaactgttgtcctttttccactaacagttatctttgactctcttgcctgttatgcttacaaaatggtgatggcttatggaaggctgttaaattaatattcctgttaaaggaaattaaagtttgtctatttttgacaataaaacattatatatttttaaaaaaatt

SEQ ID NO: 66985 - DNA, 1084 bp, Homo sapiens
  misc_feature (828)..(828): n is a, c, g, or t
cggacgcgtgggtccggacgcgtgggtgatatttttgtgtgtagttgattactcttccattgagtgaatgatgaatacctgtgaggataggaaattagttctgagatctagtccctctctgattcacttagtaatctatcctcttttcagtattacatgtgcttaatctcagatgaaccatttcaccatggcagtgttatctcatctctgggcttttctgggaattgaagtatctctccttaaccccaattgtcaagggtagtagctgtatactaccactttgaattattgaaacgggtcaatttacgaagtctgcattggctatggagatatggtttatagtacagcctagagaatgaaactcaccgtccagataaccatgcatgcacccagattttttccaccttggatacctgtcactagggaataataaaggccttattttttgtcttattccaactaagtagatcattatctctttccttttttatgttaatgagagaatttagcctccactcaacaatgttcaattcagcaaggctttcatatccttgctgtgggtcgtggataaggagcttattcaggtttcctgccctagctattagctccacttcacatgctggagaccggcgtagggacagatgtattcatcctggtgttactgaaaaacaggtgtgatcctgttactgatactataagtgacctaaaatgtcactgttcaaattagccagtgttctaacaaactaaactcttcaaatgcttggaaagatactacaaagccaatctttatagaattgggccaagataaatctatgttgttttgcatgnctattgttaagctccaaaggttcactgtgtttctgccgctgtcctggagttgtcaccactgactgggcaaggcttcttgggcatcgatgtagaactgttgtcctttttccactaacagttatctttgactctcttgcctgttatgcttacaaaatggtgatggcttatggaaggctgttaaattaatattcctgttaaaggaaattaaagtttgtctatttttgacaataaaacattatatatttttaaaaaaatt

SEQ ID NO: 66986 - DNA, 674 bp, Homo sapiens
ttttttttgtttttgaggcaaaagtcagtagccaatatttgtaacccccaaacttgaaactatccaaatgttcaatagaatggaaatatacaaatttaggcataggccgctctgcctacagagtagctatgctttattctttcactttcttaataaacttgctttcactaaaaaaaaaaaaaaaaaatttaggcatatccacacaatgaaaccctatgcagcagtaagaattaacaccataaacacatgagaaaatataaatttcacaaacatgttgactgaaaaacacaaaagaatatatgctctataattccacttactacaataatcaaaatgaatctatggtattaaaagtcaggataggccgggcgtggtggctcacgcctgtaatcccagctctttgggaggccgaaccaggtagattacctgaggtcaggagtttgagaccagcctggccaacatggtgaaaccccgtctctactaaaaatacaaaaattagccagacgtggtggtgggtgcctgtaatctcggctactcaggaggctgaggcaggagaatcacttgaacccgggaggcagaggttgcagtgagccgagattgcgccactgcaccccagcctgggccacacaccccacccagcctgggcgacaagagcaaagctccgtctatataaa

SEQ ID NO: 66987 - DNA, 199 bp, Homo sapiens
ttttttttgtttttgaggcaaaagtcagtagccaatatttgtaacccccaaacttgaaactatccaaatgttcaatagaatggaaatatacaaatttaggcataggccgctctgcctacagagtagctatgctgagtcagaatgtctgcgtgttccagagtgtctgtctaacaccgcttaagattagccactgcatgac

SEQ ID NO: 66988 - DNA, 383 bp, Homo sapiens
ttcaccatgaaattgaaaatgtttcgatatattggccttcaggagctactgctagagaattctgtaactctgtatagtagccttatgtgtataatgtagcttttgacaggtgtctgtaaattaagtcagcatagtaactatctcagttaacagtaaactatcttagtttattgattttagaagtagtggagaggaagggctataacagaaaggaccaaaatcttgtaaagagttccacttgtaatagcaacaggcagctggaaacagaaagacctgttagcaggagttccattgcccagtacttaaaactggccattgttgagatctctctggaaagagatcagtattagtggcttttggacctgctctattaattttaatgc

SEQ ID NO: 66989 - DNA, 380 bp, Homo sapiens
gtatttttaacttgttaaaacatacttttagttaatattgtatccgtttatatgtaatgtaagtgcctaatgactacttgttatttttcatttcctctcatagatgctatggttttcataaatattataagtacatatattataaatcctatgatatagtattatcagtttctctttacatagccatatattataaaaaaattaaaagtaataaaatattactgtatatttaccaaaatatttgctattactgcagtcttcagtgattcatgaaggattgagtttccattttacgtcaatgctctttagactcaaagactcccttcatattttctgtattcaggtgtattagaaataaacactttttattcttattttca

SEQ ID NO: 66990 - DNA, 249 bp, Homo sapiens
gcaagtaggtttaaatttgcatttatttattcatttttaattgtaattattatctttttagatggagactcactctgttgcccaggctggagtgcagtggtgtgatctcagctcaccgcagcctcctgctcccagttcaagggattcttgtgcctcagcctcccaagtaactgggattacaggcgcctgccaccacacctagctaatttttgtatttttagtagagatgggggtttcaccatgttggtg

SEQ ID NO: 66991 - DNA, 630 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagagg

SEQ ID NO: 66992 - DNA, 1136 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggaacaaccaaacaaaaacaaaaaaaaaaaattccggggctctcttttgtgggggtgtgcggacaacaggcgggtcatgcaatggcgcccaggtggccaataaggtgtttccgtgaccccagttttcttgtcccccagggggaaaacttggacggggttacccattatggagagagggggaataaatttcgagaaaagcccgggtttatccgggctttattagatctgtgggaaaatcatagtagagatataaacaaggagaaagagaaaaaaacaatgggggcagtagacaacatattggagaagaaaaaaaaggtggggctagaaaacaagataaaacaatagttgacccaataaataagccatcaagagcacgccgaacaaaaaaacaaacaagaagagctaagaaccccagctattactaccctacatagaagagacaggagagaatagaataaattgaaccaaagtagagtgagtggactgacacacaaaagatgaacactgt

SEQ ID NO: 66993 - DNA, 713 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggcacttccccgctacctacaatcatgtcggcccgccttggcccagccgactttagacttgggcacgtcttgctgtcgccgccct

SEQ ID NO: 66994 - DNA, 674 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggaaaataaacaaccattctcgacataaacaaaaaacattggcgtc

SEQ ID NO: 66995 - DNA, 399 bp, Homo sapiens
gccacgcccgagtgggtgtttgtttttcctttttgactttgttttgaaatgctgagaaactaaaaatctggcagtggctgtgtgtatgtggcaaggtcatggtttgctgggtctttttcagatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagagg

SEQ ID NO: 66996 - DNA, 503 bp, Homo sapiens
  misc_feature (12)..(12): n is a, c, g, or t
  misc_feature (25)..(25): n is a, c, g, or t
  misc_feature (45)..(45): n is a, c, g, or t
caccctaagganagtggagcagaanacaggaaggaccctgggccnttttgacgcagaacacaggaaggaccctgggcctttgctgacgcagaacgcgggaaggaccctgggcctttgctgacataccagccccagactacttaaattcagctttttttttaatgtgagaaaataaatgcacccctctctggtttaagccactgatttttgggttttctgttaggtgcagccagacccacctgtaagtactttttacatgagggcgttttcacaagccttgttaggcagcatccccattttaagcccaaggaaacagtgcctgatgaggcgctgttagtcgtggaatgctggagtcaggtgtgtgcacataagcagccttgggcttctgcggccgtgcatgcagccagggagcccgactggctgtgctttcagaggggacagtcgtcaaagtgcccaggacagagacctccacttctgcttcctgagcttctgacaagggccag

SEQ ID NO: 66997 - DNA, 2193 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccaggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtt

SEQ ID NO: 66998 - DNA, 2503 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccaggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtttaagccactgatttttgggttttctgttaggtgcagccagacccacctgtaagtactttttacatgagggcgttttcacaagccttgttaggcagcatccccattttaagcccaaggaaacagtgcctgatgaggcgctgttagtcgtggaatgctggagtcaggtgtgtgcacataagcagccttgggcttctgcggccgtgcatgcagccagggagcccgactggctgtgctttcagaggggacagtcgtcaaagtgcccaggacagagacctccacttctgcttcctgagcttctgacaagggccag

SEQ ID NO: 66999 - DNA, 2511 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtttaactttccgggccaggcattgattcatgaagagggtgaggtgttccagacagacagactcggagtctaggtggttcggctcctggagtgtgaactgggtaaggcttggctgcctgctcttcgcttctcctgcaaacaccagacgtcgccctagcaaagtatttaggcttgtacccagcacggccactgcaggaccagcccagcatgggcatttcctgtgattcaaggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccaggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtt

SEQ ID NO: 67000 - DNA, 2213 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagtgggtctgtttctcttagcaggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccaggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtt

SEQ ID NO: 67001 - DNA, 2260 bp, Homo sapiens
cacgagggtgaccagcggcgggtcacgtgacgcggtgcctggcgccgagcctcccaagatggcggtgtgcatcgcggtgattgccaaggagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtgttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccaggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtt

SEQ ID NO: 67002 - DNA, 2153 bp, Homo sapiens
gagctcggcaccgttgaacccacaaggactacaagttaactttccgggccaggcattgattcatgaagagggtgaggtgttccagacagacagactcggagtctaggtggttcggctcctggagtgtgaactgggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccaggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtt

SEQ ID NO: 67003 - DNA, 1966 bp, Homo sapiens
tgaacattcgtgtccaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccaggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtt

SEQ ID NO: 67004 - DNA, 1301 bp, Homo sapiens
accttgaggatctcccgactagccgacagatgcaaagaagggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccaggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtt

SEQ ID NO: 67005 - DNA, 819 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtttaactttccgggccaggcattgattcatgaagagggtgaggtgttccagacagacagactcggagtctaggtggttcggctcctggagtgtgaactgggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagagg

SEQ ID NO: 67006 - DNA, 948 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtttaactttccgggccaggcattgattcatgaagagggtgaggtgttccagacagacagactcggagtctaggtggttcggctcctggagtgtgaactgggtaaggcttggctgcctgctcttcgcttctcctgcaaacaccagacgtcgccctagcaaagtatttaggcttgtacccagcacggccactgcaggaccagcccagcatgggcatttcctgtgattcaaggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagagg

SEQ ID NO: 67007 - DNA, 711 bp, Homo sapiens
  misc_feature (644)..(645): n is a, c, g, or t
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagagggaaaaaaaaaaaanncttgccgccgaatttcgagctacatgggaccaatcggcctataaggagggcggatacttcctggcc

SEQ ID NO: 67008 - DNA, 960 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggaaaccaaaaaaaaaaaaaaaaacacccacaacacacaggggggagcaagacaacagaaataaccaccagaggcgcgcaaagatcacagtgaccacaagtcagtggaccaagggcgcccaaaaagggagaccagataacaccgcatgcaacagcggccgctccgtaccaacaagccacaagacgggaaaccacgcgcaccagaggaaccccccgtgcaaaagggaacccaatacacccagagggcgggtggacacacaaactggcgcaccaaccaacacccaacccgcacaatctaccaggccccccacagcacacaatataaaaagatcaaacgcgagccaacgggggacaaaacaacgagaaataccccgccaccaagaagagacagacacagggcaatgcacaacacgaatttccg

SEQ ID NO: 67009 - DNA, 2140 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggtgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtt

SEQ ID NO: 67010 - DNA, 2170 bp, Homo sapiens
cacgagggtgaccagcggcgggtcacgtgacgcggtgcctggcgccgagcctcccaagatggcggtgtgcatcgcggtgattgccaaggagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccaggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtt

SEQ ID NO: 67011 - DNA, 2382 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtttaactttccgggccaggcattgattcatgaagagggtgaggtgttccagacagacagactcggagtctaggtggttcggctcctggagtgtgaactgggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccaggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtt

SEQ ID NO: 67012 - DNA, 2501 bp, Homo sapiens
ctggtttgcagaggaagtgggacacttctgctttgtacctgcaaggatttctttctgtgcttttcagggggagccaccacctttgagcaggggataatagtttcatttatttcattaggccttgcctcttatgtcactagacactcgtctagtcccttgggacaaatcacttgaggccatggaattcaaagaccttcccaaaagtcatcatgtagcctgtccatggtgacatttgctagtagccactattttacttaactttccgggccaggcattgattcatgaagagggtgaggtgttccagacagacagactcggagtctaggtggttcggctcctggagtgtgaactgggtaaggcttggctgcctgctcttcgcttctcctgcaaacaccagacgtcgccctagcaaagtatttaggcttgtacccagcacggccactgcaggaccagcccagcatgggcatttcctgtgattcaaggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacgtatttgccttttcatcccatctagcaagcacagtgttaattttagaaattatagaagaaaaaatcagcaaggagtgtgggaaaactgcatgccccaggcctcccccgccccaggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtt

SEQ ID NO: 67013 - DNA, 325 bp, Homo sapiens
cacgagggtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggttgtatctttcagggcagggtgtgtgtcagggaggacctacagttgcaagatgtactttagg

SEQ ID NO: 67014 - DNA, 349 bp, Homo sapiens
ataaaagacacatgtgactcagaagagctatagaacgttgtcactaaaaatggatttgaggaggctgcgggaggggcagatctaagatgacttcccgcacattaaatctggaaaaatgatggcacagtggatggcaacaaggaaactggtgagtggatcctgtttagggcagggttagttttattgtttttatgcttgacttaatggtaataagagttaaactaactgggccaggcgcagtggctcacgcctgtaatcccagcactttgggaggcccaggcgggtggatcacgaggtcaggagatcaagaccatcctggctaacacggtgaaaccccatctctactaaa

SEQ ID NO: 67015 - DNA, 479 bp, Homo sapiens
atacacctatgcttaagtcttgagaggatataaaagagagttgtgggcaggatcaatgaggcagatttgtggagactttctagaagaatgttttcatagtgtttggaaggcagcagtagatatggataagcccagagaaggtgagaatacagggtgggcgataagcgtatcaattacatacagcctggtcctggatcctttaaaagaagcaattcttaaaaaaaaaaaaaaaaaatgagaaagagatctctagtctgactggttgggtgctatttcctattcagctcttcatgcaatacctcactaactgccacccaatttcaagcctcccattcctgggaaacacaatggagagggaggaagttggctaactcgaagaaacacctggagacgaacagcagcttttctcagttatgcttttgacttggacagggagtggaaattctactgagggctcaacaggtgatctcctttgggct

SEQ ID NO: 67016 - DNA, 284 bp, Homo sapiens
ggccctgtacttcctgatgatttcaaaagaatggctcgcagatcattgagaaaaatatccctgcgttgtgggagatacatacatgtctcaaagggacagaggaaggattcaccactataagccctttttaataaatgctctccgaaagagaggtcaaggcctcgcatcaggggctgggaagaacaaatggtaagttccttaggcagccttgggtttttccagacaggaattcaagggtgtggccttggcctgctagaagctatgctggggtttggccaagtctc

SEQ ID NO: 67017 - DNA, 989 bp, Homo sapiens
  misc_feature (2)..(3): n is a, c, g, or t
  misc_feature (176)..(176): n is a, c, g, or t
  misc_feature (368)..(368): n is a, c, g, or t
  misc_feature (579)..(579): n is a, c, g, or t
  misc_feature (638)..(638): n is a, c, g, or t
tnngacagtccccaacttatgacggtttgacttacaattttgaccttactatgggtttatcggggcattgaatgcattttcaacttatgttattttcaatttatgatgggattactaggatgtaacaccattgcaagtcaaggggcatctatacttgctagaataatctcttaaanttataaatcaggtcttgtcgcttccgtatttaaaaccagccaatcactcccatcacactcagagtaaagttaaagtctttccaggctgggtgcagtggttcacgcctgtaatcccagcactttgggaggccaaggtgggcggatcacttgaggccaggagtttgagaccagcctggccaacatggcgaaacnccgtctctactaaaaatacaaaaactagccaggcatggtggtgtgtgcctgtaattctagctacttgggaggctaaagcatgagagtcacttgaacccgggaggcagaggttgcagtgagccgagatggcgccattgcactccagcctgggcaacaaagtgagactctgtctcaaaaaaaaaaaaaaaaaaaaaaaaaaagaaaagaaaangtctttccagcagcccgaaaaactccacacaatctgcccctgcccaactgtgccttccnttcccaccctctccccagttcactctgttccaacagcactggcctcctccctactgtcaaaagatgaggcttggtcctacctcagggcctttgcacttgctgttccctctaccagatgcctcttccccccgatcactatagatcactgcatgcttcttatcattctagctttggctttaatgtcacctgctctttgatgtcacctgcccttagaagtctttcctggcttgttgcggtggctcatgcctgtaatcccagcactttgggaggccaaggcaggtggatcacttgaggtcaggagttcaagaccagcctgaccaacatggtgaaacccgtctctactaaaaatac

SEQ ID NO: 67018 - DNA, 396 bp, Homo sapiens
ttttaaaatgaaagggtgactcatgggagaagcctctggaactgcctttgaaaaacaaccagccaagacatgagaaattagttcctctgccatttgggggtttcctgccaactgctgggttttccttttgcacagcagggaggaaggacgcctgtttcccttggtcccggtgaggccaggcctcagcttcctgcccacccgccactgctgctggggcagggaggcagtttccggctgtggggacccagacaatgcctggccaaggcaccatcgtcctcttcctggacacagctcccgcctcatcccagggtctggcctgggacacgccctagaggccctcagccctgagtcactgcaccatgcagatccaccctgattctggtccctgcagagcag

SEQ ID NO: 67019 - DNA, 437 bp, Homo sapiens
gtgggctcctgttgggctggtatttctaaccaccagttgtcctttgtaccaagttctgtcaactagcttggtagctgaggacatactgcttggcaaagttgaggacctaaagtgcaaaatcctatctgtaaaggctattgctaattatacatgtgtctaacttatatatgttgtacactctaaaatcccccccttttttttttttaagacagtttccttcttccctctgttgcctaggctggagtgcagtggtgtgatctcagctcactgcaacctccagctcccaggctcaagcaattctcatctgtagtcccagctactcaggaggctgagatgagtggatcacctgagctcgggaagtcaagcctccagtgagctgagattgcgctactgtgcccctgcactccagcctgggcgacagaatactctgtctcaaa

SEQ ID NO: 67020 - DNA, 3690 bp, Homo sapiens
actgctggggtccatgtgtacgtgtggcatgtggggcaggaggctctgcagcaggccatgtggatgggcttctaccagctcacccccgaggagctggtgagtgaccactggcggaacctgcagaggttcctcagccataagctggacatcaaacgggctaacattcacttggccagcctccagcctgcagaggccgtggctggtgtggatgtgctcctggtctttgaggggcattctggaaccttctacgagtttcaggagctagcatccatcatcactcactcagccaaggagatggagcattcagtgggggttcagatgcggtcagctatgcccatggtgccctgccaggggccaacctgccagggtcaaatctgccataacacagtgcatctggaccccaaggttgggcccacgtacagcaccgccaggctcagcatcctaaccccgcggcaccacctgcagaggagctgctcctgcaatggtactgctacaaggttcagtggtcagagctatgtgcggtacagggccccagcggctcggaactggcacatccatttctatctgaaaacactccagccacaggccattcttctattcaccaatgaaacagcgtccgtctccctgaagctggccagtggagtgccccagctggaataccactgtctgggtggtttctatggaaacctttcctcccagcgccatgtgaatgaccacgagtggcactccatcctggtggaggagatggacgcttccattcgcctgatggttgacagcatgggcaacacctcccttgtggtcccagagaactgccgtggtctgaggcccgaaaggcacctcttgctgggcggcctcattctgttgcattcttcctcgaatgtctcccagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccacggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagcgaggagatggtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgggtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcccggggtgggcgagagacaggagggctccctgatctgccggctctcagtccccggggcagagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgtta

SEQ ID NO: 67021 - DNA, 3225 bp, Homo sapiens
agcactttgagggtttttatgctctgcaaatgccatgtctaaaacagccaaacacccccctcctacccataaaaatacaaacaacattctttgaactggcagcctcttagcaggtttacaaggactccttggctttgctgatggctgtttggatttcctttgcagctggccagtggagtgccccagctggaataccactgtctgggtggtttctatggaaacctttcctcccagcgccatgtgaatgaccacgagtggcactccatcctggtggaggagatggacgcttccattcgcctgatggttgacagcatgggcaacacctcccttgtggtcccagagaactgccgtggtctgaggcccgaaaggcacctcttgctgggcggcctcattctgttgcattcttcctcgaatgtctcccagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccacggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagcgaggagatggtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgggtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcccggggtgggcgagagacaggagggctccctgatctgccggctctcagtccccggggcagagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgtta

SEQ ID NO: 67022 - DNA, 3740 bp, Homo sapiens
agcactttgagggtttttatgctctgcaaatgccatgtctaaaacagccaaacacccccctcctacccataaaaatacaaacaacattctttgaactggcagcctcttagcaggtttacaaggactccttggctttgctgatggctgtttggatttcctttgcagctggccagtggagtgccccagctggaataccactgtctgggtggtttctatggaaacctttcctcccagcgccatgtgaatgaccacgagtggcactccatcctggtggaggagatggacgcttccattcgcctgatggttgacagcatgggcaacacctcccttgtggtcccagagaactgccgtggtctgaggcccgaaaggcacctcttgctgggcggcctcattctgttgcattcttcctcgaatgtctcccagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccacggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagcgaggagatggtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgggtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcccggggtgggcgagagacaggagggctccctgatctgccggctctcagtccccggggcagagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgttaaaaaaaaaaaaaaaaaaaaaaaaaaaaaaaaaaaaaaaaaaaaagagggggggggggcaaaaagattccccggggggggcccaattctacgggctacaacagaggtttttctttggtaaaagggggggccccataataggggagagccgttattattacaaccgacatgagagaccgggcgccgcgatgtattacaccaaacggttcgagacagactggggaaaacacgtcggtcacgtggggagagaacttgtggggagcaggagccacattaatactatggcgggggggggcgagcaaccataagttgggggagccaacgcctaccccataaccgagggaatactaccacagcccccctataagggggtacaaatacttaaacaatctttcaagggagggcataacgggtggtgtctaaccaccacgagcgggcaaaatatggacgtgcacgggatgagaacaaaattttggggctcccggggggtatttaaccgtgtggcaaacacttattc

SEQ ID NO: 67023 - DNA, 3157 bp, Homo sapiens
agcactttgagggtttttatgctctgcaaatgccatgtctaaaacagccaaacacccccctcctacccataaaaatacaaacaacattctttgaactggcagcctcttagcaggtttacaaggactccttggctttgctgatggctgtttggatttcctttgcagctggccagtggagtgccccagctggaataccactgtctgggtggtttctatggaaacctttcctcccagcgccatgtgaatgaccacgagtggcactccatcctggtggaggagatggacgcttccattcgcctgatggttgacagcatgggcaacacctcccttgtggtcccagagaactgccgtggtctgaggcccgaaaggcacctcttgctgggcggcctcattctgttgcattcttcctcgaatgtctcccagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccacggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagcgaggagatggtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgggtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcccggggtgggcgagagacaggagggctccctgatctgccggctctcagtccccggggcagagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgatgtgatctcgctcgggatcctctagacgaccc

SEQ ID NO: 67024 - DNA, 1579 bp, Homo sapiens
gtcggtaccggtgtatatcgatgccaccatgtctgtgccccccaactatgagggctctgacatggtggagagtgattatggcagctgtgaggaggtcatgttctagcttcccattcccagagcaaggcaggcgggaggccaaggactggacttggcttatttcttcctgtctcgtagggggtgagttgagtgtggctgggagagtgggagggaagccctcagcccaggctgttgtcccttgaaatgtgctcttccaatcccccacctagtccctgagggtggagggaagctgaggatagagctccagaaacagcactagggtcccaggagaggggcatttctagagcagtgaccctggaaaaccaggaacaattgactcccggggtgggcgagagacaggagggctccctgatctgccggctctcagtccccggggcagagcctgattgactgtgctggctcaacttcaccaagatgcattctcatacctgcccacagctccattttggaggcaggcaggttggtgcctgacagacaaccactacgcgggccgtacagaggagctctagagggctgcgtggcatcctcctaggggctgagaggtgagcagcaggggagcgggcacagtcccctctgcccctgcctcagtcgagcactcactgtgtctttgtcaagtgtctgctccacgtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgtta

SEQ ID NO: 67025 - DNA, 934 bp, Homo sapiens
ttagctagtagaggcctgggtgaatcggcagagggttgtccagtcaggcactgtgctttgcaccggggagaaaatggtgatggagggcaacaaggactccgaggagcaccaccaggcctcgggccccagaggtcccactcctcagcctacacgcagaggaacgggcccacctcagagtcacaccactggctgccagtcagggcctgccaggagtctacacagctctgaaccttctttgttaaagaattcagacctcatggaactctgggttcttcatcccaagtttcccaggcacttttggccaaaggaaggaaggaactaattcttcattttaaaaattcttaggcactttttgaccttgctgtctggatgagtttcctcaatgggatttttcttccctagacacaaggaagtctgaactcctatttagggccggttggaagcagggagctggaccgcagtgtccaggctggacacctgccattgcctcctctccattgcagacgcctgcccatcaagtattacctgcggcgactcaaccctatgcatggagggtcaatgtgggcacatgtctacacatgtgggtgcccatggatagtacgtgtgtacacatgtgtagagtgtatgtagccaggagtggtggggaccagaagcctctgtggcctttggtgacctcaccactccctcccacccagtccctccctctggtccactgccttttcatatgtgttgtttctggagacagaagtcaaaaggaagagcagtggagccttgcccacagggctgctgcttcatgcgagagggagatgtgtgggcgagagccaatttgtgtgagtggtttgtggctgtgtgtgtgactgtgagtgtgagtgacagatacatagtttcattggtcattttttttttaacaataaagtatctttttttactgtta

SEQ ID NO: 67026 - DNA, 1090 bp, Homo sapiens
agcactttgagggtttttatgctctgcaaatgccatgtctaaaacagccaaacacccccctcctacccataaaaatacaaacaacattctttgaactggcagcctcttagcaggtttacaaggactccttggctttgctgatggctgtttggatttcctttgcagctggccagtggagtgccccagctggaataccactgtctgggtggtttctatggaaacctttcctcccagcgccatgtgaatgaccacgagtggcactccatcctggtggaggagatggacgcttccattcgcctgatggttgacagcatgggcaacacctcccttgtggtcccagagaactgccgtggtctgaggcccgaaaggcacctcttgctgggcggcctcattctgttgcattcttcctcgaatgtctcccagggctttgaaggctgcctggatgctgtcgtggtcaacgaagaggctctagatctgctggcccctggcaagacggtggcaggcttgctggagacacaagccctcacccagtgctgcctccacagtgactactgcagccagaacacatgcctcaatggtgggaagtgctcatggacccacggggcaggctatgtctgcaaatgtcccccacagttctctgggaagcactgtgaacaaggaagggagaactgtacttttgcaccctgcctggaaggtggaacttgcatcctctcccccaaaggagcttcctgtaactgccctcatccttacacaggagacaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaagaccccaaaagagcaaagaccccaa

SEQ ID NO: 67027 - DNA, 516 bp, Homo sapiens
ttttaacaataaagtatctttttttactgttattttctgtgtcctttagcctgtttggggtcaggggaacgatgcaagggtccacaggccgttccaagattcatggattttgggagctggaagggatcctagagattgtcaagcaacagagattcccaacctggcaacattacctatcccagacacaaaaccagaacttctgggggtggggcccaggaaactatttggaaaaaaccctctgcctctgatacaactgtctgcagtggttcaagcccctccatttagatggggctctggggctctgaggctctgagtgatgagtccactaactagcaggctagctaaagcccaggacaagacctggggcttcctgcccttgccagcactctttgcactgcatggcattagttacggagaagggacttaactatcagaagtcttgggaagctggccctcctgggacccagagtcagcctctggctgctactccacagcgcacccttagtcgccagctaa

SEQ ID NO: 67028 - DNA, 582 bp, Homo sapiens
ggggggtgaaaaacgggagatggtaggttttggggggagcagtctctatcccatagatctctgtaagaggggacatggaaagggcaatttcatgacttggccccctgactactctgtctccgcaggtgtgaaatggaggcgaggggttgttcagaaggacactgcctagtcactcccgagatccaaaggggggactgggggcagcaggagttactgatcatcacagtggccgtggcgttcattatcataagcactgtcgggcttctcttctactgccgccgttgcaagtctcacaagcctgtggccatggaggacccagacctcctggccaggagtgttggtgttgacacccaagccatgcctgccatcgagctcaacccattgagtgccagctcctgcaacaacctcaaccaaccggaacccagcaaggcctctgttccaaatgaactcgtcacatttggacccaattctaagcaacggccagtggtctgcagtgtgccccccagactcccgccagctgcggtcccttcccactctgacaatgagcctgtcattaagagaacctggtccagcgaggagatg

SEQ ID NO: 67029 - DNA, 631 bp, Homo sapiens
attggattctatgttatcaacgtaagccaacagagacaacctgcacagatgggcctatgcccacccactcccatctccaccactcgctaggttatatatagttgctatagagccagctgaaaccttccggggagaaaatgagctcaccctatcttgctgttccctttcagtgtaccctggcggagccatggtctggccccctacttactccaggaacgaacgctgggaatacccccactccgaagtgactcagggccctctgccgccctcggctcaccgccactcaaccccagtcgtgatgccagagcctaatggcctctatgggggcttccccttccccctggagatggaaaacaagcgggcacctctcccaccccgttacagcaaccagaacctggaagatctgatgccctctcggccccctagtccccgggagcgcctggttgccccctgtctcaatgagtacacggccatcagctactaccactcgcagttccggcagggagggggagggccctgcctggcagacgggggctacaagggggtgggtatgcgcctcagccgagctgggccctcttatgctgtctgtgaggtggagggggcacctcttgcaggccagggccagccccgg

SEQ ID NO: 67030 - DNA, 563 bp, Homo sapiens
tccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaactta

SEQ ID NO: 67031 - DNA, 552 bp, Homo sapiens
caacttaggctagggtacgaggcctgggttgtcgggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaactta

SEQ ID NO: 67032 - DNA, 540 bp, Homo sapiens
caggctggagtgcagtggcatgatctcagctcactgcaacttgccctgccaggggcaagcgattcctgtgcctcagccacccgggtagctgggattacaggtgtgcgccaccatgcccagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaactta

SEQ ID NO: 67033 - DNA, 512 bp, Homo sapiens
atccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaactta

SEQ ID NO: 67034 - DNA, 1009 bp, Homo sapiens
  misc_feature (786)..(786): n is a, c, g, or t
tccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaacaaaaaaaaaaaaaaaaaaaaaaaaaaaaaaaaaaaaaagggggggttttttggggggggggaaaaaagggtgtaaaaggggcaggggtcacaaagtgtcgttccccggaccccccgtcttttggcaccaggggggagaatcgcggggggcccccaaaagggggggggcataaatcggagaacgcgggtacctgtaatatccggcgacagcacnccctcacagcatcagcgacaacaccacaccaacaggacgcccaccgatcgtacaccaacagcccgacacaacacgaaccacatacacaaccatacacatagtcacccacacaacccaacgacatcctccctaagcacaacgaccaacgccactacacactactaaccacaccgcaccactaccccacacatcatcccaaacctacgcagctcacacgcgacgc

SEQ ID NO: 67035 - DNA, 916 bp, Homo sapiens
tccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaacaaaaaaaaaaaaaaaaaaaaaaaaaaaaaaaaaaaaaacctccggcggaccctactcttgcggggggcgagaaaaaggagcacacgaatgggcacagggtgaccacagttgtttcctgaccccagttttctgtcaccagagggggggaaatactcggcggggcccccaaagaaaggggggcagagaaaagctgcggaaccaccgcggggtcacccgataatactgccgagcagaaacaggcggagaacgcacccgcgcagcagggcggcccaagttgcaacagcaggcctatcgaacaaccattctaggaaaacacagcgtgacaccaaaacacgcaacacgt

SEQ ID NO: 67036 - DNA, 1181 bp, Homo sapiens
tccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaggaaacaaaaaaacaaacaaacaaaaaaaaaaaaacaaaaaaaaaaaaaaaaaaaaaaaaaaaaaaaaacaaaaagggggcgcgcgcgcgcccatcagaaaatatctctcccccggggggccccacacattcagcgcgcgtacccccacacattgtttctataagaaaacaagagggtgcccccactataaatgagaagcagggttatatatatataaatacccaaggacgacgagcacctgggcgagcagtagttataataaaaaacgacgtgcaagaaaggagcgacaaacacagtgtagacgagagaggaagattctttgagaagaaggcaccatactatttcgggagggggaggagaccaaaccagtgggagcgacaacccatcccaccactgaggatatatttaagagactgctacataggggagaataatcatataaatatataaacggaggtgtataatgggggggtgataaaacaataagaggcaattatatatgagatggcgaggctaggaagagaaactgttgggaggacacaaggggggattgtaaattttggtgagagagaattttttttatagaggagagggagatattgctaataaaaaaggg

SEQ ID NO: 67037 - DNA, 5919 bp, Homo sapiens
  misc_feature (3053)..(3053): n is a, c, g, or t
ccaactcctggagtcccctgggagctgccgctgcaggcccccgagccgctaggccccgccgccaggccaccgctgctgcggcagccatggcggaagttcatagacgtcagcatgctcgggttaaaggagaagcccccgcgaaatcctccacactccgagatgaggaggagctggggatggcgtcggccgaaacgctgaccgtgtttctgaagctgctggccgccggcttttacggcgtgagctccttcctgatcgtggtggtgaataagagcgtgctcaccaattacagatttccctcctcactatgtgttggacttggccagatggtggccacagtggcagttctctgggtgggaaaggcgctcagagtagtcaagtttcctgaccttgacagaaatgtacctcgaaagacgtttccactacctctactatattttgggaaccaaatcacgggactgttcagcacaaagaaactgaacttgccaatgtttacagttctgagaaggttctccatcctgtttacaatgtttgctgaaggagttttactcaagaagactttttcttggggtattaaaatgactgtatttgcaatgattattggagcctttgtagctgccagctctgacttggcatttgatctggaaggatatgcttttattctgataaacgatgtcctaacagcagcaaatggtgcatacgtaaaacaaaaattagattcaaaagagctgggaaaatatggactgctctattacaatgcactgttcatgattctgcccaccctggccattgcgtatttcacaggagatgcacaaaaggctgtggagtttgaaggctgggctgacaccctctttcttctgcagttcaccctctcctgtgtgatggggtttatcttaatgtacgccacagtactctgcacgcagtataattctgctcttacaactacaatagttggctgtattaagaatatattaataacttatattggaatggtctttggtggagattatattttcacgtggacaaacttcattggtttaaatatcagcattgctgggagcctggtatattcctatatcactttcactgaagagcagctgagcaaacagtcagaggctaataacaagctggacattaaggggaaaggagcagtgtgaccagaggattgcttcatctgatacgtaggcctaagtttttaatcaactcagaacactggcagttcctacagagacactgaggtgtcttgattatggaggaaataaccattcctttgcacttgtacaatctgaggattgattgctgccttttaaaattttatgaagagagaaacttataattgactctattttaaatatgttgtttgaattaatttatatcagactggaaaaggtactgggctttttaatttatttttcttatatgccgacagtgaaacatcagtgttttgaaagtattttatttcataatttgatatccaggtgtccctgagagctgcatatgtaatgtttgccaactggagcttcatcattcaaattgttgctgcatctggaggcagtttagcctttcctctgctggaaatgcagacgaatatgtgaaatttctcttctttgaatcttatttcttatgattgcattgtcttcatcatatcatcattccatttgccaaggaaaacaactttggcactataaaaatatgtggggctttgaagtgtattgctatctatgttggcttccctgactttcataggatgagcagagtgcattccttgaaaacatgttctttttttgttgtgtagaatggggataatgaagggggtgagaaagtaggccttttactaatttttcatctatttgacttattgattcaactaaaatgttttaagtatatgtgccaggcattgtgctaaatgctggggatacagagatgtttgcagaggtagttgaaacatctcactcctgccatagtgactcaggtaaggttgagaatttagctctgttaatctattcagaagatgtcactaagagtaagttgtttcagcactcaaaagccgcaaatctgtaaattggattaagaacacctgccctacctacccggcaatagtgtgaatccaaatgctgcaatgtgagatgaggtacaagtaaagagctgtgttttgtaaaccagtgcagctcagcattgactccctctctaagtgaaaattgcagacaggcaagtctgttttcccttgccaccttcctttgggtttggttgctctttggatgaatatgatgaggtcccacatttctgaatttattggtttgaggggaaaggctggttagacgtctttgtattgtcaatggttggtttttctctggcagtgtcagtgttagagctatcatcttccttcttaaatggcatgagcaatgagcaaacttccctcctttcaacattctcacctacatcatgtgccccttggctcacctactgagcttgccaacttctctcaaaaccaatgctgcattttgggagagcagctgtgaatgggcactgcctaaattgcctcttggggtaatctggagggtggaggtgttaactcaaacataaccctatgacttgactcagagatatccattgactttgaggattagtgtgtttgctcaggccagttgtacagccagtgtgcaagagatttggtacctttgcactaatgcacacaccagtgtctatttcattgggtttggaatccactggactctgttgacctaaacagttagggttttgattttttttgatatgcaaatttatattgagatcattttcatattcctgtcttttggtttgtctttactaaagcttggctggtggtgctgtgtccctagaattatccctgcaaccaactcccaagttacaagcttcattaagagccttagactcacttttttctagcatcttctgacctgagaaaattccactgggagtaaaggatagtatcttgtgtcatatgggtcttactctccctattttaccaatgagaaaacaaaactcagagaaagatgacttgctaatacatcaaaccnatgtcctttttattgaactatgctgccatttaattaaccgcccttcccctctgagggagtaaggaaacagatcctgagttcacttgagcactttcaaaaaagcaagcagttgattgaatttggtgtcagagaggagcatactttgcaaatcaggaagagtgacagcttaccctgtcctggaacccttatcccacttccaggctgactttagttgataatgcacttctggctgtaaatgttgccaacacttcctggttttgcttaggtacagtgaaagggcatagtgagagctatttttagtgattctgttctttctgtcagcaacatgaaggagggacgtttgaataatttttgttgtagaatatttcttcatgaaaggcttttgggtgtctttaacaggtgttgggctagagccccaccaggagttgaactgcctcttgggggtcaggttccctaggagatctgtcacctcttcaggagtatttgagaacattgtgtagttacagcttcactaaatgcacgtgacaggcttctgtgccttgggagccctggcttatgctgaaacttctggctgaccagagcagtacagcaactttgccctgtctgtgttctgcttcctggatgcatccttcagccactaaccagcattgcaagatggagcagggtgaacaagctggagactgaatagtcttttggagtttgcgttttgattattgcaggcgtgttacaatatactggtgatttacctggtactgtggcacctcccagaaagtctggtttttgccccatgtttgatatttactaggcagaaattctttgtcctgttaactgcctcctgggagaaaaagaggcaatacagagttaaatccttaatttgcccactgagacagatgagctgtggtattccaaaagacaaattctatgactagtgtctcctgttcaatgtaagtgagaccctctttggccaatctgcttctagtcaaggctaaatggattggaataaccctagttggccaggctacacattgccagcatgtcccgttgagttttaattgcctcatgtggctgtggactttatgagtcaatcatttgtaggctccagtttgcacctagtttttttttttaaaaagtgcatttacacgcttttggtagtcctgttttatcaagaatccatggagggttttggtcagtacagctggtgcaggatcctcacggagaaacagtggagtttcacattgagttggtttgaaatggcaccccaggactttgggcctgccttacttgatagcctcgttcagtgagcaaagacttagtgagcagctcttgtatgccaagtattttgctaagctctggaaaaaagataaacaagacatggttcttgctttcaaggagtgtgtaattctttagccagatatggaaacctggaccctgagtgggagaaaggagacagatgaaaggagtccgtgattttgtaaccaagagctgcctgcatggttatgagtatcactgattttagggacgccccacagagctaaagcatttttttaatccgagaggacttttgtaactcatattagttaatcttctagctctgagatagcaacacagctcttagaattctgtaagtagcttgaggcctcctcctctactgtacatgttcttgctttcccaaaattgtaagtttggtttttcctatgaacaagactgtaattgatttttctctccctgaggaaaaaagttcggaataaatgagacatggatatgaaactacttagcacaatgcctggtacatattaggccctcagcaaatgtggctaccgtgtcattatttcatggtgagactcaaggcaaaacaagattcttaatttatgctccgtaaatgctagaggcttgggcaatacggtctgtcctgaaaaacaggactctgtgtctcattgcctctagaatccttaggtagcagtttctgttcactgtcttttcttttttaaaaatatctgctggacacaattacggccattacatgatgcaggtgattctacctattttttaaaaagaacaaaatttcttttatattgtgacagtacattttaataaaggaaaattattttcttccccctactccccctccttttttttttctggtaaagacagggtctcactctgttgccagactggtctcaaactcctggcctcaagtaacccttctgtctcagcctcccaaagtgctgggattacaggtgtgtgccacatgtccggccaggaaaattattttctatcttaaagaaacatagttacattttagaatgtcaattcagttaaatctttctcagtttttacctttagatggctcctggaaaggccagcgttccttttcccctctctgaattgaaagcacttgaccccatgctgcccctgcttccaggcctgtctcagttgtcatatattgtgagtccctggcaccattactgttttctaagccagtcttctaggtcttactttcaggatgctgcttcatggcatgaggatatagtttacagtgttgtagtttttttttttttaaagctttgttctttaaaaatactttttaaaaagaaatctactggttagatttattgtctcacaaaaatgtttttagagattatttttttcacaaatgttttctttctcatgctgatgatcaactgatttttgtctacaggtgttagcttctcacagtattttttcattttagagtctatttaccaaatgaccatttttagtgttaaaaggtactgaggaattgaggtatgtaaatcaggtgacataaacatgaaaattatgtgcctaaatatttttgtaatggtgtaaaataaatactttttcctga

SEQ ID NO: 67038 - DNA, 5898 bp, Homo sapiens
  misc_feature (3053)..(3053): n is a, c, g, or t
ccaactcctggagtcccctgggagctgccgctgcaggcccccgagccgctaggccccgccgccaggccaccgctgctgcggcagccatggcggaagttcatagacgtcagcatgctcgggttaaaggagaagcccccgcgaaatcctccacactccgagatgaggaggagctggggatggcgtcggccgaaacgctgaccgtgtttctgaagctgctggccgccggcttttacggcgtgagctccttcctgatcgtggtggtgaataagagcgtgctcaccaattacagatttccctcctcactatgtgttggacttggccagatggtggccacagtggcagttctctgggtgggaaaggcgctcagagtagtcaagtttcctgaccttgacagaaatgtacctcgaaagacgtttccactacctctactatattttgggaaccaaatcacgggactgttcagcacaaagaaactgaacttgccaatgtttacagttctgagaaggttctccatcctgtttacaatgtttgctgaaggagttttactcaagaagactttttcttggggtattaaaatgactgtatttgcaatgattattggagcctttgtagctgccagctctgacttggcatttgatctggaaggatatgcttttattctgataaacgatgtcctaacagcagcaaatggtgcatacgtaaaacaaaaattagattcaaaagagctgggaaaatatggactgctctattacaatgcactgttcatgattctgcccaccctggccattgcgtatttcacaggagatgcacaaaaggctgtggagtttgaaggctgggctgacaccctctttcttctgcagttcaccctctcctgtgtgatggggtttatcttaatgtacgccacagtactctgcacgcagtataattctgctcttacaactacaatagttggctgtattaagaatatattaataacttatattggaatggtctttggtggagattatattttcacgtggacaaacttcattggtttaaatatcagcattgctgggagcctggtatattcctatatcactttcactgaagagcagctgagcaaacagtcagaggctaataacaagctggacattaaggggaaaggagcagtgtgaccagaggattgcttcatctgatacgtaggcctaagtttttaatcaactcagaacactggcagttcctacagagacactgaggtgtcttgattatggaggaaataaccattcctttgcacttgtacaatctgaggattgattgctgccttttaaaattttatgaagagagaaacttataattgactctattttaaatatgttgtttgaattaatttatatcagactggaaaaggtactgggctttttaatttatttttcttatatgccgacagtgaaacatcagtgttttgaaagtattttatttcataatttgatatccaggtgtccctgagagctgcatatgtaatgtttgccaactggagcttcatcattcaaattgttgctgcatctggaggcagtttagcctttcctctgctggaaatgcagacgaatatgtgaaatttctcttctttgaatcttatttcttatgattgcattgtcttcatcatatcatcattccatttgccaaggaaaacaactttggcactataaaaatatgtggggctttgaagtgtattgctatctatgttggcttccctgactttcataggatgagcagagtgcattccttgaaaacatgttctttttttgttgtgtagaatggggataatgaagggggtgagaaagtaggccttttactaatttttcatctatttgacttattgattcaactaaaatgttttaagtatatgtgccaggcattgtgctaaatgctggggatacagagatgtttgcagaggtagttgaaacatctcactcctgccatagtgactcaggtaaggttgagaatttagctctgttaatctattcagaagatgtcactaagagtaagttgtttcagcactcaaaagccgcaaatctgtaaattggattaagaacacctgccctacctacccggcaatagtgtgaatccaaatgctgcaatgtgagatgaggtacaagtaaagagctgtgttttgtaaaccagtgcagctcagcattgactccctctctaagtgaaaattgcagacaggcaagtctgttttcccttgccaccttcctttgggtttggttgctctttggatgaatatgatgaggtcccacatttctgaatttattggtttgaggggaaaggctggttagacgtctttgtattgtcaatggttggtttttctctggcagtgtcagtgttagagctatcatcttccttcttaaatggcatgagcaatgagcaaacttccctcctttcaacattctcacctacatcatgtgccccttggctcacctactgagcttgccaacttctctcaaaaccaatgctgcattttgggagagcagctgtgaatgggcactgcctaaattgcctcttggggtaatctggagggtggaggtgttaactcaaacataaccctatgacttgactcagagatatccattgactttgaggattagtgtgtttgctcaggccagttgtacagccagtgtgcaagagatttggtacctttgcactaatgcacacaccagtgtctatttcattgggtttggaatccactggactctgttgacctaaacagttagggttttgattttttttgatatgcaaatttatattgagatcattttcatattcctgtcttttggtttgtctttactaaagcttggctggtggtgctgtgtccctagaattatccctgcaaccaactcccaagttacaagcttcattaagagccttagactcacttttttctagcatcttctgacctgagaaaattccactgggagtaaaggatagtatcttgtgtcatatgggtcttactctccctattttaccaatgagaaaacaaaactcagagaaagatgacttgctaatacatcaaaccnatgtcctttttattgaactatgctgccatttaattaaccgcccttcccctctgagggagtaaggaaacagatcctgagttcacttgagcactttcaaaaaagcaagcagttgattgaatttggtgtcagagaggagcatactttgcaaatcaggaagagtgacagcttaccctgtcctggaacccttatcccacttccaggctgactttagttgataatgcacttctggctgtaaatgttgccaacacttcctggttttgcttaggtacagtgaaagggcatagtgagagctatttttagtgattctgttctttctgtcagcaacatgaaggagggacgtttgaataatttttgttgtagaatatttcttcatgaaaggcttttgggtgtctttaacaggtgttgggctagagccccaccaggagttgaactgcctcttgggggtcaggttccctaggagatctgtcacctcttcaggagtatttgagaacattgtgtagttacagcttcactaaatgcacgtgacaggcttctgtgccttgggagccctggcttatgctgaaacttctggctgaccagagcagtacagcaactttgccctgtctgtgttctgcttcctggatgcatccttcagccactaaccagcattgcaagatggagcagggtgaacaagctggagactgaatagtcttttggagtttgcgttttgattattgcaggcgtgttacaatatactggtgatttacctggtactgtggcacctcccagaaagtctggtttttgccccatgtttgatatttactaggcagaaattctttgtcctgttaactgcctcctgggagaaaaagaggcaatacagagttaaatccttaatttgcccactgagacagatgagctgtggtattccaaaagacaaattctatgactagtgtctcctgttcaatgtaagtgagaccctctttggccaatctgcttctagtcaaggctaaatggattggaataaccctagttggccaggctacacattgccagcatgtcccgttgagttttaattgcctcatgtggctgtggactttatgagtcaatcatttgtaggctccagtttgcacctagtttttttttttaaaaagtgcatttacacgcttttggtagtcctgttttatcaagaatccatggagggttttggtcagtacagctggtgcaggatcctcacggagaaacagtggagtttcacattgagttggtttgaaatggcaccccaggactttgggcctgccttacttgatagcctcgttcagtgagcaaagacttagtgagcagctcttgtatgccaagtattttgctaagctctggaaaaatatggaaacctggaccctgagtgggagaaaggagacagatgaaaggagtccgtgattttgtaaccaagagctgcctgcatggttatgagtatcactgattttagggacgccccacagagctaaagcatttttttaatccgagaggacttttgtaactcatattagttaatcttctagctctgagatagcaacacagctcttagaattctgtaagtagcttgaggcctcctcctctactgtacatgttcttgctttcccaaaattgtaagtttggtttttcctatgaacaagactgtaattgatttttctctccctgaggaaaaaagttcggaataaatgagacatggatatgaaactacttagcacaatgcctggtacatattaggccctcagcaaatgtggctaccgtgtcattatttcatggtgagactcaaggcaaaacaagattcttaatttatgctccgtaaatgctagaggcttgggcaatacggtctgtcctgaaaaacaggactctgtgtctcattgcctctagaatccttaggtagcagtttctgttcactgtcttttcttttttaaaaatatctgctggacacaattacggccattacatgatgcaggtgattctacctattttttaaaaagaacaaaatttcttttatattgtgacagtacattttaataaaggaaaattattttcttccccctactccccctccttttttttttctggtaaagacagggtctcactctgttgccagactggtctcaaactcctggcctcaagtaacccttctgtctcagcctcccaaagtgctgggattacaggtgtgtgccacatgtccggccaggaaaattattttctatcttaaagaaacatagttacattttagaatgtcaattcagttaaatctttctcagtttttacctttagatggctcctggaaaggccagcgttccttttcccctctctgaattgaaagcacttgaccccatgctgcccctgcttccaggcctgtctcagttgtcatatattgtgagtccctggcaccattactgttttctaagccagtcttctaggtcttactttcaggatgctgcttcatggcatgaggatatagtttacagtgttgtagtttttttttttttaaagctttgttctttaaaaatactttttaaaaagaaatctactggttagatttattgtctcacaaaaatgtttttagagattatttttttcacaaatgttttctttctcatgctgatgatcaactgatttttgtctacaggtgttagcttctcacagtattttttcattttagagtctatttaccaaatgaccatttttagtgttaaaaggtactgaggaattgaggtatgtaaatcaggtgacataaacatgaaaattatgtgcctaaatatttttgtaatggtgtaaaataaatactttttcctgaaaacaagtattaaaattcctttgtaactgcata

SEQ ID NO: 67039 - DNA, 6147 bp, Homo sapiens
  misc_feature (3053)..(3053): n is a, c, g, or t
ccaactcctggagtcccctgggagctgccgctgcaggcccccgagccgctaggccccgccgccaggccaccgctgctgcggcagccatggcggaagttcatagacgtcagcatgctcgggttaaaggagaagcccccgcgaaatcctccacactccgagatgaggaggagctggggatggcgtcggccgaaacgctgaccgtgtttctgaagctgctggccgccggcttttacggcgtgagctccttcctgatcgtggtggtgaataagagcgtgctcaccaattacagatttccctcctcactatgtgttggacttggccagatggtggccacagtggcagttctctgggtgggaaaggcgctcagagtagtcaagtttcctgaccttgacagaaatgtacctcgaaagacgtttccactacctctactatattttgggaaccaaatcacgggactgttcagcacaaagaaactgaacttgccaatgtttacagttctgagaaggttctccatcctgtttacaatgtttgctgaaggagttttactcaagaagactttttcttggggtattaaaatgactgtatttgcaatgattattggagcctttgtagctgccagctctgacttggcatttgatctggaaggatatgcttttattctgataaacgatgtcctaacagcagcaaatggtgcatacgtaaaacaaaaattagattcaaaagagctgggaaaatatggactgctctattacaatgcactgttcatgattctgcccaccctggccattgcgtatttcacaggagatgcacaaaaggctgtggagtttgaaggctgggctgacaccctctttcttctgcagttcaccctctcctgtgtgatggggtttatcttaatgtacgccacagtactctgcacgcagtataattctgctcttacaactacaatagttggctgtattaagaatatattaataacttatattggaatggtctttggtggagattatattttcacgtggacaaacttcattggtttaaatatcagcattgctgggagcctggtatattcctatatcactttcactgaagagcagctgagcaaacagtcagaggctaataacaagctggacattaaggggaaaggagcagtgtgaccagaggattgcttcatctgatacgtaggcctaagtttttaatcaactcagaacactggcagttcctacagagacactgaggtgtcttgattatggaggaaataaccattcctttgcacttgtacaatctgaggattgattgctgccttttaaaattttatgaagagagaaacttataattgactctattttaaatatgttgtttgaattaatttatatcagactggaaaaggtactgggctttttaatttatttttcttatatgccgacagtgaaacatcagtgttttgaaagtattttatttcataatttgatatccaggtgtccctgagagctgcatatgtaatgtttgccaactggagcttcatcattcaaattgttgctgcatctggaggcagtttagcctttcctctgctggaaatgcagacgaatatgtgaaatttctcttctttgaatcttatttcttatgattgcattgtcttcatcatatcatcattccatttgccaaggaaaacaactttggcactataaaaatatgtggggctttgaagtgtattgctatctatgttggcttccctgactttcataggatgagcagagtgcattccttgaaaacatgttctttttttgttgtgtagaatggggataatgaagggggtgagaaagtaggccttttactaatttttcatctatttgacttattgattcaactaaaatgttttaagtatatgtgccaggcattgtgctaaatgctggggatacagagatgtttgcagaggtagttgaaacatctcactcctgccatagtgactcaggtaaggttgagaatttagctctgttaatctattcagaagatgtcactaagagtaagttgtttcagcactcaaaagccgcaaatctgtaaattggattaagaacacctgccctacctacccggcaatagtgtgaatccaaatgctgcaatgtgagatgaggtacaagtaaagagctgtgttttgtaaaccagtgcagctcagcattgactccctctctaagtgaaaattgcagacaggcaagtctgttttcccttgccaccttcctttgggtttggttgctctttggatgaatatgatgaggtcccacatttctgaatttattggtttgaggggaaaggctggttagacgtctttgtattgtcaatggttggtttttctctggcagtgtcagtgttagagctatcatcttccttcttaaatggcatgagcaatgagcaaacttccctcctttcaacattctcacctacatcatgtgccccttggctcacctactgagcttgccaacttctctcaaaaccaatgctgcattttgggagagcagctgtgaatgggcactgcctaaattgcctcttggggtaatctggagggtggaggtgttaactcaaacataaccctatgacttgactcagagatatccattgactttgaggattagtgtgtttgctcaggccagttgtacagccagtgtgcaagagatttggtacctttgcactaatgcacacaccagtgtctatttcattgggtttggaatccactggactctgttgacctaaacagttagggttttgattttttttgatatgcaaatttatattgagatcattttcatattcctgtcttttggtttgtctttactaaagcttggctggtggtgctgtgtccctagaattatccctgcaaccaactcccaagttacaagcttcattaagagccttagactcacttttttctagcatcttctgacctgagaaaattccactgggagtaaaggatagtatcttgtgtcatatgggtcttactctccctattttaccaatgagaaaacaaaactcagagaaagatgacttgctaatacatcaaaccnatgtcctttttattgaactatgctgccatttaattaaccgcccttcccctctgagggagtaaggaaacagatcctgagttcacttgagcactttcaaaaaagcaagcagttgattgaatttggtgtcagagaggagcatactttgcaaatcaggaagagtgacagcttaccctgtcctggaacccttatcccacttccaggctgactttagttgataatgcacttctggctgtaaatgttgccaacacttcctggttttgcttaggtacagtgaaagggcatagtgagagctatttttagtgattctgttctttctgtcagcaacatgaaggagggacgtttgaataatttttgttgtagaatatttcttcatgaaaggcttttgggtgtctttaacaggtgttgggctagagccccaccaggagttgaactgcctcttgggggtcaggttccctaggagatctgtcacctcttcaggagtatttgagaacattgtgtagttacagcttcactaaatgcacgtgacaggcttctgtgccttgggagccctggcttatgctgaaacttctggctgaccagagcagtacagcaactttgccctgtctgtgttctgcttcctggatgcatccttcagccactaaccagcattgcaagatggagcagggtgaacaagctggagactgaatagtcttttggagtttgcgttttgattattgcaggcgtgttacaatatactggtgatttacctggtactgtggcacctcccagaaagtctggtttttgccccatgtttgatatttactaggcagaaattctttgtcctgttaactgcctcctgggagaaaaagaggcaatacagagttaaatccttaatttgcccactgagacagatgagctgtggtattccaaaagacaaattctatgactagtgtctcctgttcaatgtaagtgagaccctctttggccaatctgcttctagtcaaggctaaatggattggaataaccctagttggccaggctacacattgccagcatgtcccgttgagttttaattgcctcatgtggctgtggactttatgagtcaatcatttgtaggctccagtttgcacctagtttttttttttaaaaagtgcatttacacgcttttggtagtcctgttttatcaagaatccatggagggttttggtcagtacagctggtgcaggatcctcacggagaaacagtggagtttcacattgagttggtttgaaatggcaccccaggactttgggcctgccttacttgatagcctcgttcagtgagcaaagacttagtgagcagctcttgtatgccaagtattttgctaagctctggaaaaaagataaacaagacatggttcttgctttcaaggagtgtgtaattctttagccagatatggaaacctggaccctgagtgggagaaaggagacagatgaaaggagtccgtgattttgtaaccaagagctgcctgcatggttatgagtatcactgattttagggacgccccacagagctaaagcatttttttaatccgagaggacttttgtaactcatattagttaatcttctagctctgagatagcaacacagctcttagaattctgtaagtagcttgaggcctcctcctctactgtacatgttcttgctttcccaaaattgtaagtttggtttttcctatgaacaagactgtaattgatttttctctccctgaggaaaaaagttcggaataaatgagacatggatatgaaactacttagcacaatgcctggtacatattaggccctcagcaaatgtggctaccgtgtcattatttcatggtgagactcaaggcaaaacaagattcttaatttatgctccgtaaatgctagaggcttgggcaatacggtctgtcctgaaaaacaggactctgtgtctcattgcctctagaatccttaggtagcagtttctgttcactgtcttttcttttttaaaaatatctgctggacacaattacggccattacatgatgcaggtgattctacctattttttaaaaagaacaaaatttcttttatattgtgacagtacattttaataaaggaaaattattttcttccccctactccccctcctttttttaaaaaaaaaaaaaaaaaaagaaagaaggtcttgctctgtcgccagccaggctggagtgtaatggcgtaatcatagcagctcaccacagtctcaaactcctaggctcaagtgatcctcctgccttagcctgctaagtagctacgactatagggcatgtgccattacgcctggctcgtttcttccttttcttttttttttctggtaaagacagggtctcactctgttgccagactggtctcaaactcctggcctcaagtaacccttctgtctcagcctcccaaagtgctgggattacaggtgtgtgccacatgtccggccaggaaaattattttctatcttaaagaaacatagttacattttagaatgtcaattcagttaaatctttctcagtttttacctttagatggctcctggaaaggccagcgttccttttcccctctctgaattgaaagcacttgaccccatgctgcccctgcttccaggcctgtctcagttgtcatatattgtgagtccctggcaccattactgttttctaagccagtcttctaggtcttactttcaggatgctgcttcatggcatgaggatatagtttacagtgttgtagtttttttttttttaaagctttgttctttaaaaatactttttaaaaagaaatctactggttagatttattgtctcacaaaaatgtttttagagattatttttttcacaaatgttttctttctcatgctgatgatcaactgatttttgtctacaggtgttagcttctcacagtattttttcattttagagtctatttaccaaatgaccatttttagtgttaaaaggtactgaggaattgaggtatgtaaatcaggtgacataaacatgaaaattatgtgcctaaatatttttgtaatggtgtaaaataaatactttttcctgaaaacaagtattaaaattcctttgtaactgcata

SEQ ID NO: 67040 - DNA, 995 bp, Homo sapiens
ccaactcctggagtcccctgggagctgccgctgcaggcccccgagccgctaggccccgccgccaggccaccgctgctgcggcagccatggcggaagttcatagacgtcagcatgctcgggttaaaggagaagcccccgcgaaatcctccacactccgagatgaggaggagctggggatggcgtcggccgaaacgctgaccgtgtttctgaagctgctggccgccggcttttacggcgtgagctccttcctgatcgtggtggtgaataagagcgtgctcaccaattacagatttccctcctcactatgtgttggacttggccagatggtggccacagtggcagttctctgggtgggaaaggcgctcagagtagtcaagtttcctgaccttgacagaaatgtacctcgaaagacgtttccactacctctactatattttgggaaccaaatcacgggactgttcagcacaaagaaactgaacttgccaatgtttacagttctgagaaggttctccatcctgtttacaatgtttgctgaaggagttttactcaagaagactttttcttggggtattaaaatgactgtatttgcaatgattattggagcctttgtagctgccagctctgacttggcatttgatctggaaggatatgcttttattctgataaacgatgtcctaacagcagcaaatggtgcatacgtaaaacaaaaattagattcaaaagagctgggaaaatatggactgctctattacaatgcactgttcatgattctgcccaccctggccattgcgtatttcacaggagatgcacaaaaggctgtggagtttgaaggctgggctgacaccctctttcttctgcagttcaccctctcctgtgtgatggggtttatcttaatgtacgccacagtactctgcacgcagtataattctgctcttacatgaaaattatgtgcctaaatatttttgtaatggtgtaaaataaatactttttcctga

SEQ ID NO: 67041 - DNA, 460 bp, Homo sapiens
gcctcatccttttggttttcttgtctatgaaattgagctctgcctgcttctgcctgcttcacagatgtacttaatggtaatttggtgcttgttgtcatctggctttgaatgcagagcggtgtgctattaaatgacatgaatgaccgttgctaattatgtgtttaaatgttagtgcctcttatttctgaggaatcccttattgaggtgaaattgcaaactatgaccagaaatcaagaaatactagtagctgataaaatgcctaatattcacttccctagatgagaatatgttcttgtaaatattttagcttatatctatttaaaattaaatgcatgttctttaagttgttcttaaagtgttgcttatgttttgcagctctgacttggcatttgatctggaaggatatgcttttattctgataaacgatgtcctaacagcagcaaatggtgcatacgtaaaa

SEQ ID NO: 67042 - DNA, 5952 bp, Homo sapiens
  misc_feature (3053)..(3053): n is a, c, g, or t
ccaactcctggagtcccctgggagctgccgctgcaggcccccgagccgctaggccccgccgccaggccaccgctgctgcggcagccatggcggaagttcatagacgtcagcatgctcgggttaaaggagaagcccccgcgaaatcctccacactccgagatgaggaggagctggggatggcgtcggccgaaacgctgaccgtgtttctgaagctgctggccgccggcttttacggcgtgagctccttcctgatcgtggtggtgaataagagcgtgctcaccaattacagatttccctcctcactatgtgttggacttggccagatggtggccacagtggcagttctctgggtgggaaaggcgctcagagtagtcaagtttcctgaccttgacagaaatgtacctcgaaagacgtttccactacctctactatattttgggaaccaaatcacgggactgttcagcacaaagaaactgaacttgccaatgtttacagttctgagaaggttctccatcctgtttacaatgtttgctgaaggagttttactcaagaagactttttcttggggtattaaaatgactgtatttgcaatgattattggagcctttgtagctgccagctctgacttggcatttgatctggaaggatatgcttttattctgataaacgatgtcctaacagcagcaaatggtgcatacgtaaaacaaaaattagattcaaaagagctgggaaaatatggactgctctattacaatgcactgttcatgattctgcccaccctggccattgcgtatttcacaggagatgcacaaaaggctgtggagtttgaaggctgggctgacaccctctttcttctgcagttcaccctctcctgtgtgatggggtttatcttaatgtacgccacagtactctgcacgcagtataattctgctcttacaactacaatagttggctgtattaagaatatattaataacttatattggaatggtctttggtggagattatattttcacgtggacaaacttcattggtttaaatatcagcattgctgggagcctggtatattcctatatcactttcactgaagagcagctgagcaaacagtcagaggctaataacaagctggacattaaggggaaaggagcagtgtgaccagaggattgcttcatctgatacgtaggcctaagtttttaatcaactcagaacactggcagttcctacagagacactgaggtgtcttgattatggaggaaataaccattcctttgcacttgtacaatctgaggattgattgctgccttttaaaattttatgaagagagaaacttataattgactctattttaaatatgttgtttgaattaatttatatcagactggaaaaggtactgggctttttaatttatttttcttatatgccgacagtgaaacatcagtgttttgaaagtattttatttcataatttgatatccaggtgtccctgagagctgcatatgtaatgtttgccaactggagcttcatcattcaaattgttgctgcatctggaggcagtttagcctttcctctgctggaaatgcagacgaatatgtgaaatttctcttctttgaatcttatttcttatgattgcattgtcttcatcatatcatcattccatttgccaaggaaaacaactttggcactataaaaatatgtggggctttgaagtgtattgctatctatgttggcttccctgactttcataggatgagcagagtgcattccttgaaaacatgttctttttttgttgtgtagaatggggataatgaagggggtgagaaagtaggccttttactaatttttcatctatttgacttattgattcaactaaaatgttttaagtatatgtgccaggcattgtgctaaatgctggggatacagagatgtttgcagaggtagttgaaacatctcactcctgccatagtgactcaggtaaggttgagaatttagctctgttaatctattcagaagatgtcactaagagtaagttgtttcagcactcaaaagccgcaaatctgtaaattggattaagaacacctgccctacctacccggcaatagtgtgaatccaaatgctgcaatgtgagatgaggtacaagtaaagagctgtgttttgtaaaccagtgcagctcagcattgactccctctctaagtgaaaattgcagacaggcaagtctgttttcccttgccaccttcctttgggtttggttgctctttggatgaatatgatgaggtcccacatttctgaatttattggtttgaggggaaaggctggttagacgtctttgtattgtcaatggttggtttttctctggcagtgtcagtgttagagctatcatcttccttcttaaatggcatgagcaatgagcaaacttccctcctttcaacattctcacctacatcatgtgccccttggctcacctactgagcttgccaacttctctcaaaaccaatgctgcattttgggagagcagctgtgaatgggcactgcctaaattgcctcttggggtaatctggagggtggaggtgttaactcaaacataaccctatgacttgactcagagatatccattgactttgaggattagtgtgtttgctcaggccagttgtacagccagtgtgcaagagatttggtacctttgcactaatgcacacaccagtgtctatttcattgggtttggaatccactggactctgttgacctaaacagttagggttttgattttttttgatatgcaaatttatattgagatcattttcatattcctgtcttttggtttgtctttactaaagcttggctggtggtgctgtgtccctagaattatccctgcaaccaactcccaagttacaagcttcattaagagccttagactcacttttttctagcatcttctgacctgagaaaattccactgggagtaaaggatagtatcttgtgtcatatgggtcttactctccctattttaccaatgagaaaacaaaactcagagaaagatgacttgctaatacatcaaaccnatgtcctttttattgaactatgctgccatttaattaaccgcccttcccctctgagggagtaaggaaacagatcctgagttcacttgagcactttcaaaaaagcaagcagttgattgaatttggtgtcagagaggagcatactttgcaaatcaggaagagtgacagcttaccctgtcctggaacccttatcccacttccaggctgactttagttgataatgcacttctggctgtaaatgttgccaacacttcctggttttgcttaggtacagtgaaagggcatagtgagagctatttttagtgattctgttctttctgtcagcaacatgaaggagggacgtttgaataatttttgttgtagaatatttcttcatgaaaggcttttgggtgtctttaacaggtgttgggctagagccccaccaggagttgaactgcctcttgggggtcaggttccctaggagatctgtcacctcttcaggagtatttgagaacattgtgtagttacagcttcactaaatgcacgtgacaggcttctgtgccttgggagccctggcttatgctgaaacttctggctgaccagagcagtacagcaactttgccctgtctgtgttctgcttcctggatgcatccttcagccactaaccagcattgcaagatggagcagggtgaacaagctggagactgaatagtcttttggagtttgcgttttgattattgcaggcgtgttacaatatactggtgatttacctggtactgtggcacctcccagaaagtctggtttttgccccatgtttgatatttactaggcagaaattctttgtcctgttaactgcctcctgggagaaaaagaggcaatacagagttaaatccttaatttgcccactgagacagatgagctgtggtattccaaaagacaaattctatgactagtgtctcctgttcaatgtaagtgagaccctctttggccaatctgcttctagtcaaggctaaatggattggaataaccctagttggccaggctacacattgccagcatgtcccgttgagttttaattgcctcatgtggctgtggactttatgagtcaatcatttgtaggctccagtttgcacctagtttttttttttaaaaagtgcatttacacgcttttggtagtcctgttttatcaagaatccatggagggttttggtcagtacagctggtgcaggatcctcacggagaaacagtggagtttcacattgagttggtttgaaatggcaccccaggactttgggcctgccttacttgatagcctcgttcagtgagcaaagacttagtgagcagctcttgtatgccaagtattttgctaagctctggaaaaaagataaacaagacatggttcttgctttcaaggagtgtgtaattctttagccagatatggaaacctggaccctgagtgggagaaaggagacagatgaaaggagtccgtgattttgtaaccaagagctgcctgcatggttatgagtatcactgattttagggacgccccacagagctaaagcatttttttaatccgagaggacttttgtaactcatattagttaatcttctagctctgagatagcaacacagctcttagaattctgtaagtagcttgaggcctcctcctctactgtacatgttcttgctttcccaaaattgtaagtttggtttttcctatgaacaagactgtaattgatttttctctccctgaggaaaaaagttcggaataaatgagacatggatatgaaactacttagcacaatgcctggtacatattaggccctcagcaaatgtggctaccgtgtcattatttcatggtgagactcaaggcaaaacaagattcttaatttatgctccgtaaatgctagaggcttgggcaatacggtctgtcctgaaaaacaggactctgtgtctcattgcctctagaatccttaggtagcagtttctgttcactgtcttttcttttttaaaaatatctgctggacacaattacggccattacatgatgcaggtgattctacctattttttaaaaagaacaaaatttcttttatattgtgacagtacattttaataaaggaaaattattttcttccccctactccccctccttttttttttctggtaaagacagggtctcactctgttgccagactggtctcaaactcctggcctcaagtaacccttctgtctcagcctcccaaagtgctgggattacaggtgtgtgccacatgtccggccaggaaaattattttctatcttaaagaaacatagttacattttagaatgtcaattcagttaaatctttctcagtttttacctttagatggctcctggaaaggccagcgttccttttcccctctctgaattgaaagcacttgaccccatgctgcccctgcttccaggcctgtctcagttgtcatatattgtgagtccctggcaccattactgttttctaagccagtcttctaggtcttactttcaggatgctgcttcatggcatgaggatatagtttacagtgttgtagtttttttttttttaaagctttgttctttaaaaatactttttaaaaagaaatctactggttagatttattgtctcacaaaaatgtttttagagattatttttttcacaaatgttttctttctcatgctgatgatcaactgatttttgtctacaggtgttagcttctcacagtattttttcattttagagtctatttaccaaatgaccatttttagtgttaaaaggtactgaggaattgaggtatgtaaatcaggtgacataaacatgaaaattatgtgcctaaatatttttgtaatggtgtaaaataaatactttttcctgaaaacaagtattaaaattcctttgtaactgcata

SEQ ID NO: 67043 - DNA, 1578 bp, Homo sapiens
ccaactcctggagtcccctgggagctgccgctgcaggcccccgagccgctaggccccgccgccaggccaccgctgctgcggcagccatggcggaagttcatagacgtcagcatgctcgggttaaaggagaagcccccgcgaaatcctccacactccgagatgaggaggagctggggatggcgtcggccgaaacgctgaccgtgtttctgaagctgctggccgccggcttttacggcgtgagctccttcctgatcgtggtggtgaataagagcgtgctcaccaattacagatttccctcctcactatgtgttggacttggccagatggtggccacagtggcagttctctgggtgggaaaggcgctcagagtagtcaagtttcctgaccttgacagaaatgtacctcgaaagacgtttccactacctctactatattttgggaaccaaatcacgggactgttcagcacaaagaaactgaacttgccaatgtttacagttctgagaaggttctccatcctgtttacaatgtttgctgaaggagttttactcaagaagactttttcttggggtattaaaatgactgtatttgcaatgattattggagcctttgtagctgccagctctgacttggcatttgatctggaaggatatgcttttattctgataaacgatgtcctaacagcagcaaatggtgcatacgtaaaacaaaaattagattcaaaagagctgggaaaatatggactgctctattacaatgcactgttcatgattctgcccaccctggccattgcgtatttcacaggagatgcacaaaaggctgtggagtttgaaggctgggctgacaccctctttcttctgcagttcaccctctcctgtgtgatggggtttatcttaatgtacgccacagtactctgcacgcagtataattctgctcttacaactacaatagttggctgtattaagattccacagggagaaagaggtctggagcctggctggtaagaaatttttatccttatgctggctggtgaggtcctggattatctttgctgcagcttccaaaagagcagaacagctttggtgaccctgcttactgcatcaaaactgtagggatgaagggaaaatttgcttaaaaatcagctcacaaaagacagactagtaaaagaaaaggtatctaatttattgatgtgtatatggagaatattgcagagtgactacctaaacccccagtggagtgtagaagcttatatactatcttgaagttacagaaaaaatgggggcttagattgggcaaaataggttatgggagggagagaagaggaggcttggctagctaaagtggtcttgttatacagatgaaacctcacaggtagcagcccttggagagaatagatgataaatgcttttttagaccttgaaaggtgttagactctcagttagtgtttcctagatctggacaaggggaggcctggctacagtcagtgtagatttttctacaaatgtaaatttccctcacaaaagacagctttgcagagctacttctttttgctggctttctgacagctatcttaattactgt

SEQ ID NO: 67044 - DNA, 398 bp, Homo sapiens
ctggagggcataagattataggaatagagtgtcatactttatcaatacaggttttattataaatgtggaattatgaaaattagaaggaggccgggcgcagtggctcacacctataatcccatcactttgggaggctgaggcaggcggatcacgaggtcagtagatcaagaccatcctggctaacgtggtgaaaccccgtctctactaaaaatacaaaatattagccgggcgtggtagtgggcgcctgtagtcccagctactcgggaggctgaggcaggagaatggcgtgaacccgggaggcggagcttgcagtgagccgagatcgcgccattgcactccagcctgggcaacagagcaagactccgtctcaaaaaaaaaaaaaaaaaaaaaagaaaatc

SEQ ID NO: 67045 - DNA, 465 bp, Homo sapiens
gtagggttggctttttatgaaggctataaggaagaatctgcttgatacctctttgctaaaaaaaaagttctgtaaaaaaaggcattccttggcaggtagactcatgtctagagtaactgcagctatttgaccaaaagtgtaagtccaaattatgtttgtatctgaataatatgcttttataattcctcagcccacagccaattgagttgatggtagtaacctatgagagagccacccatgaaatgtgagttaaaaacaaagatttaggccaggtgcggtggctccgcctcggcctcccaaagtggtgggattacaggcctgagccaccatgcccggcctgtttgagttaattttaagtgattttttttttccttttctcactgtttcaagcaatgaaaatttatttttaaagtgcttactcaacttccctattaactgcctagaacatgtttatagatttcattt

SEQ ID NO: 67046 - DNA, 465 bp, Homo sapiens
tcagtttcaatgcactgttgttaaaaatactactaatgaatatatgcttttttttttacattaagaaatgagtgtctcactttatcgcccagggtagagtgcagtgatgagttcataactcaattgcaacctgaacttgtgggcttgaacaattctcctacctcagccaagtgagtagctgggattacaggcacccaccaccacacctgccctctcctgcttcttaaatgaagcagtatattatgaatatgttgcagattaacactgggactgtaggtaagtgtgttttggggccactttcactttttatcttaaacactttcatagtgttttattttatttttacaacgcaaatggttacttttgtcatttgaaaagcaatagaggcgccaggcacgatggctcacacctgtaatcccagcacttctggaggcctaaggtgggtggaccacctgaggtcaggag

SEQ ID NO: 67047 - DNA, 410 bp, Homo sapiens
tgcttaccataactcatataatatagaaaaataaagatgagctaatacaatcaggatgaagaaaaagaaaagtcagaataaaatgaaaggccaggaataagaacacagataagcaggccataggggcttacatagttattaaaattgcatcataaatttggctctgagcttcctggtggccaacactaaaaggaaaacagatgtatgtgctttttctcactgtctttaagaagaaacacagtgttcttggagattttcagtgtttccctggttgcagctttcaatttttcaggggctttatatagtgattttgagtaataagcaatatccttgtattcgttatctattcttgggtaaaaatcaccccaaatttagcagttaataaacaataaacttttttttccctcaca

SEQ ID NO: 67048 - DNA, 1117 bp, Homo sapiens
acccggaagtgaacaccacgagctagcgtgtctacttcacaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacactcagatcttttgaaggaaaccctaaaggagaaggaagcagaatataaccctctggagagctcaagacagtaggaacctggacggtgcttgtttgaattttctgatatctgattttcacacgaatatactttttgtttgttttccttttccattttcaaaatgccaagatctgggagcctctttcactcctctagacacactgcctgagatagaagtttgcatcttattggctgtgggcagagactaggacccttatgggtacatttcagtaatctctcactgcctaaaatggtaatccctccagcctaagaggatgattctgttttgttgactcttgaatgctcccccaacattcctttggttttcctataagcaaaaccaaataccactataaatacaaaagcatctggtaaactgtaaagttactcatgtatcccaaccctccacagatttctgaagacaaagttttgcttggattaaaacaagatgttttactattaaaaaaa

SEQ ID NO: 67049 - DNA, 850 bp, Homo sapiens
ataccttgcactgttgacgccaggttgaggactctgattgcctgacttgcaggccacgtgtttattcaaagccaatctgagaccctactctgtatcaagaactgtcccaggttctgaaagcatagaattagacatcgtatgtgccctctaagaaacacttagaactttcaaatcattataattcaatgagtcctaaaatagagctgtgtgccagagataaaagaagtcctgaggaaggggtgttcaactctgtcttggtaggtcagtaaagactttagagagacagaaagtcttagaggactaggagaagtttgccagacagacaagaatagaacattccagacaacatgcagaggaactgagtcacaaaggaatgtataagaatggcatattctaggaactaacactgtggctagagaggaaggggaaatggtgttacatgagtgagggaggggaaatggtgttacgtgagtaagaaaaaataagcagggggcaaaatcataagtagtcttacatactacattagatatcaatatttaagcctgtaggaaatgggaggcattgaagcacttaagtaaaaaagtaactatcaaatttttgttttagattactctggtcatcagagaaatagattaagtatttaagaggtagaatctctcagacttaggaaccaactgcatgaggcggggcttggggggataaatttgcaagataataaggatgtagaattgaaaaggcctgatattattgaagctggagttgcacattcattttgctttggcttttttgtatcagtggtcatgggcaccaaataaaatgcttccatgaacatttggattctggctctaaa

SEQ ID NO: 67050 - DNA, 1663 bp, Homo sapiens
  misc_feature (1552)..(1552): n is a, c, g, or t
acccggaagtgaacaccacgagctagcgtgtctacttcacaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacactcagatcttttgaaggtctgatggggacaatcaagtccaaagtctcagggggcaaaagagcttggccctgactgtctttcttctgcggagggtggggttgatctgctctcagttttggggtgtggggaagacccactccagattccggggagtgggaatgagccactcccagttctggagagtgaggatgaccatctccactttctggaaccagaatgagcccccttggtaaccttgcctggtactaaaccagtgcaaggacccccttcccttattacatttgcaactctgcccaacaaaaacaagcaagcaaaccacaatggtaaagtggttaattcaggaaattgacagaatccagttttgagaaaagaacacagatatttgctgcttttaagatagagaacccaaagttttgtacctggttatttttcacttaagtttgtagacgaaatgtgccattatattagctttcctgagactgtatctaatgggcaagtcagtggctccagaggggtcttaggccaaagcccaaactctcttttggaaaactagcttattagaaagccaaagtagagttctgtttaagcttgaaagaggtatgaagtaatctgtagtgtttttttggtttgtttgtttgttttcccttccccatttccttccttccctcagtctcaaagtcaccttgaaagcttcacctggcctacaacttttattttaaaaagatgatcaagaaaacttcatcttctctgagactcagaaaaagaggggaaaatagtggtagtgcactaattgttacattactaatatagcttttgtaaaactcgtttgttttcaaaggtctggactaagcaaaacaacagtgtcagtttaggaaattattactactttgaacacaaactgaaattgcaactttgccttgtgctttgtttataatttctttntatatcaaaatgagtgttttaaagtttaacccttgaagcagcatgtctttgccatagcagcacttcacttaaaaggaagaaattgcctctctggcagcaattcctagttag

SEQ ID NO: 67051 - DNA, 1557 bp, Homo sapiens
acccggaagtgaacaccacgagctagcgtgtctacttcacaggccaggtcgtcaactcaactgtcaaggtgtccattgtaccagctgggccatggatccctcccgcctgaaatctgactccacctgccaagagtctgagcctgcaggcctagatttcgactctgctggccaagattatttctctgcagcccaataattcgactctttctaccaagaattggacctggactctcttaacgaagatcttctttcccagtccatgccacatgccaggacagagacctctgtgggcacatatgaatcccactcgacttctgaactggaggatctgacagagcccgagcaaagagagctcaaaaccaaactcactaaattggaggctgaaattgtaaccctacgccacgtactagcagccaaagagagacgctgtggggaactcaagaggaagttaggcctcaccgccttggtagggctgagacagaatctgtccaagagctggcttgatgttcaggtctccaacacctatgtgaaacagaagacatcagctgctctgtccaccatgggcactctcatctgcaggaagcttggaggcgtgaagaagtcggccacactcagatcttttgaaggattgatcttcaataaatacacgttaaatcaaggaaggaattaacatcatatacttcagacatcaaatatggaatccaagagactatcaacaacatgaacttgttcacaagttccttctgcttttaaacaaaaatatcgtgtttattcaaagccaatctgagaccctactctgtatcaagaactgtcccaggttctgaaagcatagaattagacatcgtatgtgccctctaagaaacacttagaactttcaaatcattataattcaatgagtcctaaaatagagctgtgtgccagagataaaagaagtcctgaggaaggggtgttcaactctgtcttggtaggtcagtaaagactttagagagacagaaagtcttagaggactaggagaagtttgccagacagacaagaatagaacattccagacaacatgcagaggaactgagtcacaaaggaatgtataagaatggcatattctaggaactaacactgtggctagagaggaaggggaaatggtgttacatgagtgagggaggggaaatggtgttacgtgagtaagaaaaaataagcagggggcaaaatcataagtagtcttacatactacattagatatcaatatttaagcctgtaggaaatgggaggcattgaagcacttaagtaaaaaagtaactatcaaatttttgttttagattactctggtcatcagagaaatagattaagtatttaagaggtagaatctctcagacttaggaaccaactgcatgaggcggggcttggggggataaatttgcaagataataaggatgtagaattgaaaaggcctgatattattgaagctggagttgcacattcattttgctttggcttttttgtatcagtggtcatgggcaccaaataaaatgcttccatgaacatttggattctggctctaaa

SEQ ID NO: 67052 - DNA, 382 bp, Homo sapiens
  misc_feature (257)..(257): n is a, c, g, or t
agcacatacactaaaattggaacaatacagagattagcctggcccctgtgcaaggatgacatgcaaattcgtgaagtgtttcatatttattttattaaaaaaaaaaaaaaagaccgggcacggtggtttacacctataatcctgacactttgggaggccgaggtgggtgggtcatgagttcaggagatcgagaccatcctggccaatatggtgatccccgtctctactagaatacggaagattggctgggcatggtngtgcgcacctgtattcccggccaatatggtgaaaccccgtctctactaaaatacaaaaaattagctgggcatggtggtgcgcacctgtattcccagctactcaggaggctgaggcaagggaatca

SEQ ID NO: 67053 - DNA, 873 bp, Homo sapiens
gacagagtaagctgagagaggatatgtaacttacttaggtcacacagacagtgaatggtagaaccagaaataaaactcaaatctggctgatctcaaagtcatgctttcaacaatgctatataccatccaaaaaaaaataataatccctgtggtgtcctactagccataatattcactttacatttcattgagcgttacctgtgtgctaggaaatgtgacaagtgccttaagtagagtatctcatttcatttgaagaaacacattgtaagattgaactaggtgttctagagattatagtatgaggttgtagctccaagagtatgtagatctcagaccatagaaatttcactcttttcccagaagggaaaaaagaaatgacagatataaaagaattttttccaagctggtaagtggtttctggaaaattagcaagttgtgatatgtaggttgagcatcccaaatccaaaaaatgaaatccagtgagcttcaaaatctgaaacttcttgagtgctggcagcatttaaaggagatgcttattagggcatttcagattttggtttctggatttagggatgctgaaccagtaaattataatgcagacacttcaaattttgaaaaaaatcggccacctgtaatcccagcacttcggaaggccaaggtggttggatcatttgcatccaggagttcaagaccaccctaggcaacaaaaaatgtaaaaattaaaaaaaaaaaaaacaaaaacaaaaaacagaaaaaatccgaaacacttatgatccttagcgtttcggagaaggagtactcaacctgtactgtgttttaatctcctaggaacatattctttaagagccaggtattcttgagttaagcaaaccc

SEQ ID NO: 67054 - DNA, 542 bp, Homo sapiens
ggtgccgcaggtgtctggaattcaccttgccaaggattgagctcatgccccgtgccaccctcacgccttctacctgctcctttctcagttctttctctggaataagggcccctaattttccaaaccagaacggtgggagttatgccagattccattttcttacaaaccccaacagttaccgcatcccgttgggtccgtttcctgagtatctgtcctgttctttccgtggcgtctgccactgctgtggtcttagattactaacagagagctggatttcagaggcctccggacggtttccactgcctgctgtctcatttcagtgcaccttgcacaatgctcccactgcgataatacaaatccagccacatcactgtccccatcatctaaggacctgggcctggtccttctggtggggttagtataaactctccccttcttagggcttaccccatccctcctaacactctcagttcctgaacaggctggtcgggtgcatgtgctgcttgtgtcttgggaatacctggggactctcttttctgggt

SEQ ID NO: 67055 - DNA, 377 bp, Homo sapiens
gaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttgatat

SEQ ID NO: 67056 - DNA, 365 bp, Homo sapiens
gatgtggggaggtgttggcttccggagttaaagtccgtagtgctgaattagagggaggaatatggagaaaaatgttttcaacacaatggaactttcatacatgggagatgattaggaagtcatgattgcttcctgtggttgagaaatacgaactttatgcatttactattgtttattttaaaataatgtcctcttcatttagaaagagtttgtgtgtataaatcatatttatctttcagccttgcatatggagctctaagagtggcagtttggttattcacagttttttacctaccaaaactctgaatagaaaaagatgtttaacccataaagcaatgtgtggtacctgaagcctgttttaaatg

SEQ ID NO: 67057 - DNA, 3059 bp, Homo sapiens
ccgggcctcatgttgcgccgcctgcgcaagggcaacctgcccatccgctccatcatccccaaccacgccgacaaggagcgcttcgccacgcgctgcaaggcggccaccgtgctgctctacgacgaggccacggccgagtggcagcccgagcccggcgctcccgcctccgtgctcggcctgctcctacagaagctgcgcgacgacggctgccaggcctactacctccaaggtggtttcaacaagtttcaaacagagtactctgagcactgcgagaccaacgtggacagctcttcctcgccgagcagctcgccacccacctcagtgctgggcctggggggcctgcgcatcagctctgactgctccgacggcgagtcggaccgagagctgcccagcagtgccaccgagtcagacggcagccctgtgccatccagccaaccagccttccctgtccagatcctgccctacctctacctcggctgcgccaaggactccaccaacctggacgtgctcggcaagtatggcatcaagtatatcctcaatgtcacacccaacctacccaacgccttcgagcacggcggcgagttcacctacaagcagatccccatctctgaccactggagccagaacctctcccagttcttccctgaggccatcagcttcattgacgaagcccgctccaagaagtgtggtgtcctggtgcactgcctggcaggcatcagccgctcagtgacggtcactgtggcctatctgatgcagaagatgaacctgtcactcaacgacgcctacgactttgtcaagaggaaaaagtccaacatctcgcccaacttcaacttcatggggcagctgctggactttgagcggacgctggggctaagcagcccgtgcgacaaccacgcgtcgagtgagcagctctacttttccacgcccaccaaccacaacctgttcccactcaatacgctggagtccacgtgaggcctggtgcacggggggcatggcaccaggcccctgctcggctctccacagggctaggtgggagagcccaagcccgccacctctggcctgaggaacccccagatgtcacctgtgcccagaggcccaggctgatcggtgtcggagcgcccctcaccatccttgggggcagggcccgcaggcaaggtctcccactgcagggcttgctggagaggcctcggctcttggacacgtggctttgggcgtccaccagggcctcatcctgtccaggacgctcctttctgctgacagcccagccagtttggctgttttttaaagacacatccacggacctgagtttactttttacttttggcaggtaaatccaagctccctggagcacaaagagtgtttgagctcttcttgatttttctttttttttttttttttaacaaaaagtgttattttcaggctacatgcaacagtggattgtataacccagtatttcatccctttcctgatcctgcaagagagagaaatgttcagttttgtttttcgttcaatttcaaaaagcaagtatcgtgtttgtttttgtttttgttttttaatggaaaagacagacgccatgttgaccttgaccaaatgcgttttgcacatgtgtgaagcctctgtttcctcagcgggcccttcttgaaggggtggcttactgctcttcaggtattgggacccccagtcgtgccgcctcccacccttggcccagtctgacttagctctgcattcgcctgtgatgactgctgcaagttgtgattggtgggctggatggtggtctttgcattttctgccgtctcatccatccctctggtggtccctgcagacctccctgaggcagaaggtggggaccctggggccctgccgctgtcccccaggaggtgggccgcagggggctgccaggcagtagcattagccctctggggtcagcccctaagaaggcctgggctctgagcccttttatatacttagccactacttctgtctgtctgtctgtctctctctcttcctctccctctctctctttctctctctccctctctctctctttctttctctctccccccctccctctctcttcctttcctctctcttgttgtaactgggagtggaggcccagtggctggggagacattaggtggtggggcccagcccgacctccaggttcttccttctccctagctgttgctttggtctggccactcccagcccccttgtccccttggaagcttgccctgccctcatcttgcccatgccttctactgccaggagacttgcacccatttcaaccctagggcgggggcaagtggggcaaggatggaccagcagaaggggggtaaggctctgttcacttccccctgcctccacagaacgaagccacggattccgttatcttcctccagttttgttccttctccagcctcagttccaccaggtgtcaggactgcatgggggcctggggcaggcagaggagtcaggccagggtccctgacggagcagcactcagcatgtgagtgaggccacagaaaaactctgccccactgcttcttacctcacgggggtggctttcagggattctttagcgcagcagattaaaatcttgccacagtcgagaaattgacaacaagcttccatgctgtacatggttctctttttctctcttttatttttaaaaagaaaacccagaaagatgtaccagatttgtgtaaatgagggtatgccagaaggtggccagttttgctttatgatcttatgaaggaagatttgtgaccctacgtatatatatacacacacatacatatatatatatatcccgaaccaacaacgggactttgtttatattgcaaataaatattattttttctttaaaatgagtcgtgtccgataagggcttggggcctgggaaggaggggaaggagtgctgtcgacaggcatcctagtgcctgctctgtgtgaggcactggcctggttctgcttggggtctgctggccacttagactaatcaaggtgccccgcagatgggagggagcagccacagtttctggatgaagctggggcaggtg

SEQ ID NO: 67058 - DNA, 1662 bp, Homo sapiens
tcctgatcctgcaagagagagaaatggatgaaatactggattgtataacccagtatttcatccctttcctgatcctgcaagagagagaaatgttcagttttgtttttcgttcaatttcaaaaagcaagtatcgtgtttgtttttgtttttgttttttaatggaaaagacagacgccatgttgaccttgaccaaatgcgttttgcacatgtgtgaagcctctgtttcctcagcgggcccttcttgaaggggtggcttactgctcttcaggtattgggacccccagtcgtgccgcctcccacccttggcccagtctgacttagctctgcattcgcctgtgatgactgctgcaagttgtgattggtgggctggatggtggtctttgcattttctgccgtctcatccatccctctggtggtccctgcagacctccctgaggcagaaggtggggaccctggggccctgccgctgtcccccaggaggtgggccgcagggggctgccaggcagtagcattagccctctggggtcagcccctaagaaggcctgggctctgagcccttttatatacttagccactacttctgtctgtctgtctgtctctctctcttcctctccctctctctctttctctctctccctctctctctctttctttctctctccccccctccctctctcttcctttcctctctcttgttgtaactgggagtggaggcccagtggctggggagacattaggtggtggggcccagcccgacctccaggttcttccttctccctagctgttgctttggtctggccactcccagcccccttgtccccttggaagcttgccctgccctcatcttgcccatgccttctactgccaggagacttgcacccatttcaaccctagggcgggggcaagtggggcaaggatggaccagcagaaggggggtaaggctctgttcacttccccctgcctccacagaacgaagccacggattccgttatcttcctccagttttgttccttctccagcctcagttccaccaggtgtcaggactgcatgggggcctggggcaggcagaggagtcaggccagggtccctgacggagcagcactcagcatgtgagtgaggccacagaaaaactctgccccactgcttcttacctcacgggggtggctttcagggattctttagcgcagcagattaaaatcttgccacagtcgagaaattgacaacaagcttccatgctgtacatggttctctttttctctcttttatttttaaaaagaaaacccagaaagatgtaccagatttgtgtaaatgagggtatgccagaaggtggccagttttgctttatgatcttatgaaggaagatttgtgaccctacgtatatatatacacacacatacatatatatatatatcccgaaccaacaacgggactttgtttatattgcaaataaatattattttttctttaaaatgagtcgtgtccgataagggcttggggcctgggaaggaggggaaggagtgctgtcgacaggcatcctagtgcctgctctgtgtgaggcactggcctggttctgcttggggtctgctggccacttagactaatcaaggtgccccgcagatgggagggagcagccacagtttctggatgaagctggggcaggtg

SEQ ID NO: 67059 - DNA, 517 bp, Homo sapiens
gatgaggaaacagacacgggtgtccagtgccttggggctaaagtgtgcagagccctctccacagcagtgctgttgacctctattccaagttgctgccctacccacactgggcttggccaggtccctcaggggtcgggcaagaccagccagccaccatgctgccctctgtgccccagccccacctgcccacccatgtgggaaggctccttgaaggaggcacctccctgacccatgccaatgtgtttcagacgaagcccgctccaagaagtgtggtgtcctggtgcactgcctggcaggcatcagccgctcagtgacggtcactgtggcctatctgatgcagaagatgaacctgtcactcaacgacgcctacgactttgtcaagaggaaaaagtccaacatctcgcccaacttcaacttcatggggcagctgctggactttgagcggacgctggggctaagcagcccgtgcgacaaccacgcgtcgagtgagcagctctacttttccacgcccaccaac

SEQ ID NO: 67060 - DNA, 313 bp, Homo sapiens
ggggtggctttcagggattctttagcgcagcagattaaaatcttgccacagtcgagaaattgacaacaagcttccatgctgtacatggttctctttttctctcttttatttttaaaaagaaaacccagaaagatgtaccagatttgtgtaaatgagggtatgccagaaggtggccagttttgctttatgatcttatgaaggaagatttgtgaccctacgtatatatatacacacacatacatatatatatatatcccgaaccaacaacgggactttgtttatattgcaaataaatattattttttctttaaaa

SEQ ID NO: 67061 - DNA, 1809 bp, Homo sapiens
actcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 67062 - DNA, 276 bp, Homo sapiens
tctcttgcacaaagtggtcctttgaggacagctaggcgtgggagattcaggagctcgaggcctgacctgaaataccccgtggctggcagtctcctgggcctggtcagggtgaaggatctgatgtgtgtcctagcagttttctgcctggccgcacaggtcacccaggacaggaacgtgccctcctcagaggaacggagcagccctgcaggtgcgcccatggccagttggattctgtgacattttacacaacgtgatcagcaacactggcttccccct

SEQ ID NO: 67063 - DNA, 1603 bp, Homo sapiens
ttaacggctagtagagccccgctgaatcggccgaggcttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 67064 - DNA, 1917 bp, Homo sapiens
actcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 67065 - DNA, 1570 bp, Homo sapiens
actcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaattgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 67066 - DNA, 1828 bp, Homo sapiens
actcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtgggtgagtcacgtccccgtgggccagacaagggggaggtgcttgtccctgaccaacttccctgggtccctgttgctggtgacgtggtatcccatagaatgtctttagggactggatggtgaccaggaggggcaggaggcccttgttctatggttcagggtaaacacaggaggggcgggtcctggggtggctggtctgcagggctgtgctgggctgggcgacttccctccctagccagccccctcctcttgctgttcacagcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaattgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 67067 - DNA, 895 bp, Homo sapiens
actcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 67068 - DNA, 1106 bp, Homo sapiens
actcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggacgaagaccgtgtaaacagctgcagacaagtggctgatggggagaccccacacacactagaggctggcgcaggggaagacccaactcagggcttagaccgacgggc

SEQ ID NO: 67069 - DNA, 299 bp, Homo sapiens
cacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgtaagtgagggcagagcacccctttgttggtcttcagtgcagaagtctgggctgctgacccacacctggggcagatggggacgaggcccacctaggaatccccatgctgggaccttgagctgcctgtgtccagtgcgtgaggggagggggtg

SEQ ID NO: 67070 - DNA, 369 bp, Homo sapiens
gcagttttctgcctggccgcacaggtcacccaggacaggaacgtgccctcctcagaggaacggagcagccctgcaggtgcgcccatggccagttggattctgtgacattttacacaacgtgatcagcaacactggcttccccctcccggaatagctaatgaccacctataagttttgtttgatgttactttttttcttcttttctaggattccttcctcaaggctcagcagtggctgaaggacctggaggaggagctgcacccaggagaagtcctggtgatgctggtgggcaacaagacggacctcagccaggagcgggaggtgaccttccaggtaccgcccaggagaccctgctctgctcttccacag

SEQ ID NO: 67071 - DNA, 1961 bp, Homo sapiens
actcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 67072 - DNA, 1895 bp, Homo sapiens
actcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 67073 - DNA, 1119 bp, Homo sapiens
  misc_feature (45)..(45): n is a, c, g, or t
  misc_feature (60)..(60): n is a, c, g, or t
  misc_feature (85)..(85): n is a, c, g, or t
  misc_feature (142)..(142): n is a, c, g, or t
  misc_feature (221)..(221): n is a, c, g, or t
ccagacatctgttagaagcgagaggaggacaggctccacgggggnatcagtgtggctctnaacaaggggccgcgaggcaggccanatgctgtgcccactaggtgcagccactcctgggggctgtggggaagacaccccctgnctgggccatggccagctctaggtggattctgattcactgtcaatgctgggttgctcccgagccctagatgttcccatgnaagaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 67074 - DNA, 1904 bp, Homo sapiens
actcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 67075 - DNA, 1243 bp, Homo sapiens
ggttccccagaagaagggcccaggtgggtgccgtccaggggcctccctctgcctcatgtttcctgggttctcagttggttctttgcccagcatcaaagcccacaggtgccaacaggcatgatgggaggggaacctgggggtggggacttggctttccaggccctgcaggaggaggaaggccgcaccccgccagctagaggaagagcctcttccagggagcacaccccgcccctccctggtcctggctgctcaggagtgccaagaaacacaacttggacacgaaacgtggaggagtgcgggctccacggctgcagctttctcggatcttactgttggaagtgaaccaggtgtccttaggaaactctcttataaacagcgctggattttgtggctgtttccttcaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 67076 - DNA, 1368 bp, Homo sapiens
  misc_feature (743)..(743): n is a, c, g, or t
  misc_feature (989)..(989): n is a, c, g, or t
cacactgaggatatagaataaatggtcccttctgatctaactaggaagaaagaaagtatacacttataatgcaatttgataaagataaactcaggttgatattaaaacaggtgggccaggtaagaatatctgataaaatcaggtatagcgctctatacagaaaaacacagatcagaacaacacaaggaaacaaaaagcacttgggtttttatctttccagtctttctccccattatcactaacaatgggcattgaattaccctaaaaatctttgccaattttattggcaaaaatgaaaccccatttatatttctccaggaaatataaattaaatttgaacatttcactataaaaaaatcttttattttctttgacctctttctaatatagtgttggcacacctcttattatatgttcttcatttagggtatgatttttatctataatgctttttgctaatgtatttccagcttgtttgccttctaactttgcatataacattttttgatatgcaatgatttttgaattattaggtagtcaaatatttttcttggagtttttttccactgctttatttcttagaagttactttttctttcagaaatcagctaattgtcaaggccaggcaaagtgactaatgcctgtaattccagcactttgggaggccaaggaggatggatcatttgaggccaggagttcaagaccaacctagccaacatggcaaaaacctgtctctactaaanatacaaaaattagccaagcatggtggcacatgcctgtaatcccagctactcgggaggccgaggcaagagaatcgcttcaatccaggaggcagaggttgcagtgagccgagctggcaccactccactccagtctgggcaacagtgagaccccgtgtcaaaaaaacaacaaaaaaagaaaaagtcagctaattgttatgtgtcatttctttctagattttgtagtttttgtttgtttgttttacattnaatgatttagaagatttggggcttattgtggtttcttaaatattataactctatttcaaaactattctgctatgttgagctatcttatttcatactgtattttaatatgttaggacagttctctccttacgactttcttttgcaaaaattttctagctacactcatttggatattcttcatgatgaactctgagataattttaacacattccaaaagacatatttttgagacttattagaattttgttaaagatactgatttatttccaaagaattacagaatctaatcttttcatctatgtatctctattgaagcatttgtttatgtctcttagaatagatacattctttaaaataaaatataagctttgtgcatttt

SEQ ID NO: 67077 - DNA, 106 bp, Homo sapiens
tttctgtcaatttcaagactttttaaatattagctagattaaccttctatctgctgcaaacattgtctcccaatattttacttgtattttgctgtcatttatggtg

SEQ ID NO: 67078 - DNA, 600 bp, Homo sapiens
tagaagtttggattttttttctgattttggagtatttgcatcatatatactttactggttaatcaccccaaatgcaaaaatcccaaatctgaaacattccgatgaaaatttcctttgagcaccttgtcagcaatcaaaaagtttgggattttcgaacatttcaaatttgggatgctcaaactgtgtatctacatcttatgtttacacacaatatatatataccaattggaaaacaatgtctaaaatggttactgtaatatgctgaataaattaagttctaaagaaaacatgtccaaatgtaaatgctttatatggtcatatttgttcagaatttatcatctagcaaactaatacctgattatttcaatttgtgaaaaaactactatggtagtcccctcttattctcaggggatatattccatgaaccccagtggatgcctgaaaccacgtgtagtacaaaacaatatatatattttttcctatacatacctatcctaaagtttaatttataaattaggtacaataagagattaatgataataataaaatacaattataataatatgccataataaaagttatgtgaatgtagtctttctc

SEQ ID NO: 67079 - DNA, 445 bp, Homo sapiens
gaccataaatagtcacgggaaattatagtcgtgtgtgctacagagaaggaaataaaggtcactcctgcagtttctgaaatggttttgaagtaggaaggaaacaagtttcagcaacatagttgtttaccatcgctgtttagagtatttttatgagtctgtttctttagatcccatttagaccaccttatttcctgttaagaatttctttagtgtagcattagaataaattacaatgtaagaaataaattttattgccctaaaatatcatggactagtgttggctgggaaactatataaaataatttcattaaaatagaattctcagctgggcgcagtggctcacacctgtaatcccagcactttgggtggctgaggcgggtggatcacctgaggtcaggagttcgagaccagcctggccaacatggtgaaacccccctcctctact

SEQ ID NO: 67080 - DNA, 1900 bp, Homo sapiens
gaggcggggcgcgggcgtgcagcggcgcaggctccgccccggggccgtctccagccgggggcgccgagccgctccagtccccggcgcgccgcgggctggtgggctcagcggcggcgccggcactgggaaatgaccctgcccgggggcccaacgggcatggcgcggccggggggcgcgaggccctgcagcccggggctggagcgggccccgcgccggagtgtcggggagctgcgcctgctcttcgaggcgcgctgtgcggcggtcgctgcggccgccgccgcgggggagccccgggcccgcggggccaagcggcgtgggggacaggtccccaacgggcttccgcgggctcccccggccccggtgatccctcagctgaccgtgacagccgaggagcccgacgtgcccccgaccagccctgggccgccggagcgggagagggactgcctcccggcagcgggctcttcgcacctgcagcagccgcgccgcctttccacctcgtcggtctcctccactggctcctcgtcgctgctcgaggactcggaggacgacctgctgagcgacagtgagagccggagccgcggcaacgtgcagctggaagcgggcgaggacgtgggtcagaaaaaccactggcagaagatccggaccatggtcaatctgccggtcataagccctttcaagaagcgctacgcctgggtgcagctggcagggcacactgggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaagaaagcggacggctcctgcagcaccgacttcaagactacgcgaagccgagagcaggtgcttcgcgtctttgaagagtttgtgcaaggagatgaggaagtgctgaggcggtatctgaaccgcctgcagcagatccgggacaccctggaggtatccgagttcttcaggaggcacgaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacggctatttgctggggctggacaatctcattggcatcctggccagcctggctgagagatgaggctggactcctgtccccgcgggccgctcacctgacatgtggacctgcagctttgtccccactgtgcatgccggcttgagactggagccccgcggtgcagggcagttcaccgggtcctgcaggaccaggtgccagccactaagggggggcaccgccgatgccaggggttttgcccacccgggccccagcgttcccagagccaaatgacactaacttatagaaggggagggggcaaagggcttcttcctcaggccagctcttctgaggaggctctgccctctccagaggtgccagaccgcggattttatttagcaagcccagaccttccggtctaacgtctcacaccacgacggactccccttcctaataaaactcaaagacaaga

SEQ ID NO: 67081 - DNA, 1530 bp, Homo sapiens
cgggggccttcaactctgctcaggagctcgggccggagaaaggccccgagacttgaagcccttgcccgggagggatgaacacgcaaaggaacccgaggaacgggcagccgcgccgcctttccacctcgtcggtctcctccactggctcctcgtcgctgctcgaggactcggaggacgacctgctgagcgacagtgagagccggagccgcggcaacgtgcagctggaagcgggcgaggacgtgggtcagaaaaaccactggcagaagatccggaccatggtcaatctgccggtcataagccctttcaagaagcgctacgcctgggtgcagctggcagggcacactgggagttttaaggcggcgggcaccagcgggctgatcctgaagcgctgctcggagccggagcgctactgcctggcgcggctgatggctgacgcgctgcgcggctgcgtgcctgccttccacggcgtggtggagcgcgacggcgaaagctacctgcagctgcaggacctgctcgatggcttcgacggaccttgtgtgctcgactgcaaaatgggcgtcaggacttacctagaggaggagctgaccaaggcccgtgagcggcccaagctgcggaaggacatgtacaagaaaatgctggcggtggatcctgaagctcccacggaggaggagcacgcgcagcgcgccgtcaccaagccgcgctacatgcagtggcgggaaggcatcagctccagcaccaccctcggcttccgcatcgagggcatcaagaaagcggacggctcctgcagcaccgacttcaagactacgcgaagccgagagcaggtgcttcgcgtctttgaagagtttgtgcaaggagatgaggaagtgctgaggcggtatctgaaccgcctgcagcagatccgggacaccctggaggtatccgagttcttcaggaggcacgaggtgatcggcagctcgctcctctttgtgcacgatcactgccatcgcgccggcgtgtggctcatcgacttcggcaagaccacgcccctccccgatggccagatcctggaccaccggcggccctgggaggagggcaaccgcgaggacggctatttgctggggctggacaatctcattggcatcctggccagcctggctgagagatgaggctggactcctgtccccgcgggccgctcacctgacatgtggacctgcagctttgtccccactgtgcatgccggcttgagactggagccccgcggtgcagggcagttcaccgggtcctgcaggaccaggtgccagccactaagggggggcaccgccgatgccaggggttttgcccacccgggccccagcgttcccagagccaaatgacactaacttatagaaggggagggggcaaagggcttcttcctcaggccagctcttctgaggaggctctgccctctccagaggtgccagaccgcggattttatttagcaagcccagaccttccggtctaacgtctcacaccacgacggactccccttcctaataaaactcaaagacaaga

SEQ ID NO: 67082 - DNA, 856 bp, Homo sapiens
catccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctagccgtgccgtttctaggtgagctcctgcctggtcctgcctcctgggctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 67083 - DNA, 993 bp, Homo sapiens
catccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctgctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgatcctgtctggatgcgcagccactgctgggtgtgggattcagggacgagggcctggggtcggggcaggcccaggccaccgcctggcagaaccggagctcctacagacccatgggcagcttctggtggagaaaatacctcaagtttcttatctacaaaataaaagggtccactttcacaaactt

SEQ ID NO: 67084 - DNA, 1170 bp, Homo sapiens
catccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctatggagtctcgctctgtcaccaggctggagtgcagtggcacaatctcagctcactgcaacctcgacctcctgggttcaagcgattctcctgcctcaaccccccgagttgctggaaccacaggcgtgtgccaccatgcccagctaatttttgtatttttaatagaaacggggtttcaccatgttggccacgatggtctcaatctcttgacctcatgatccccccgctttagcctcccaaagtgctgggatttcagtgccacattcttaagggggtgtcctcaagcccaccacatccttccagggctcccccgaaacaccctgctcttcctccctctacttaagtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 67085 - DNA, 928 bp, Homo sapiens
catccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactccagagtcctggtggaggacgatgagatcatgcagggattcatcagggctttcaggcccctgcccaggcacctatggtacttgctggacttgaaacagatggaagagccgtgccgtttctagccgtgccgtttctaggtgagctcctgcctggtcctgcctcctgggctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgatcctgtctggatgcgcagccactgctgggtgtgggattcagggacgagggcctggggtcggggcaggcccaggccaccgcctggcagaaccggagctcctacagacccatgggcagcttctggtggagaaaatacctcaagtttcttatctacaaaataaaagggtccactttcacaaactt

SEQ ID NO: 67086 - DNA, 810 bp, Homo sapiens
catccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctgctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatg

SEQ ID NO: 67087 - DNA, 1039 bp, Homo sapiens
catccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctagccgtgccgtttctaggtgagctcctgcctggtcctgcctcctgggctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgatcctgtctggatgcgcagccactgctgggtgtgggattcagggacgagggcctggggtcggggcaggcccaggccaccgcctggcagaaccggagctcctacagacccatgggcagcttctggtggagaaaatacctcaagtttcttatctacaaaataaaagggtccactttcacaaactt

SEQ ID NO: 67088 - DNA, 1353 bp, Homo sapiens
catccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgagaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctatggagtctcgctctgtcaccaggctggagtgcagtggcacaatctcagctcactgcaacctcgacctcctgggttcaagcgattctcctgcctcaaccccccgagttgctggaaccacaggcgtgtgccaccatgcccagctaatttttgtatttttaatagaaacggggtttcaccatgttggccacgatggtctcaatctcttgacctcatgatccccccgctttagcctcccaaagtgctgggatttcagtgccacattcttaagggggtgtcctcaagcccaccacatccttccagggctcccccgaaacaccctgctcttcctccctctacttaagtgacctgtaaacccaacagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccacggccatggggaggctgctccctgggggcagagtctctggcagaggttattaataaacccttggagcatgatcctgtctggatgcgcagccactgctgggtgtgggattcagggacgagggcctggggtcggggcaggcccaggccaccgcctggcagaaccggagctcctacagacccatgggcagcttctggtggagaaaatacctcaagtttcttatctacaaaataaaagggtccactttcacaaactt

SEQ ID NO: 67089 - DNA, 499 bp, Homo sapiens
tgggttttcccagagccctctcaccctcacgcatctgctgtctggagggatggttggtaccgttctagggcagttcatgtgtccgctgtcctcagggcttcaggacatcaggtggggtctcgtgttcccagtgcagaggtagggcccagggcaaggggctggtgtcctgcacagctagtgtaggtgtagacagggccaccccagcgggtggctctgaagccagcccccctcacctcgcccccaaccatggccagagctcccttgttcttcagtctcccagtgatggtgtctgcaggcagcagtggagaatcctggcctggtgctgagtccaagttggcccctcctagtgctcggcacaccgagggcactttgctttcagaggaggacttgggactgaatcttacacctagagggtgaggaaccctttgcatgtttgtttgtttgtttgtttgttttttaattaaattttacagtacctattttgccttaaaaaaaaaaa

SEQ ID NO: 67090 - DNA, 938 bp, Homo sapiens
tgggttttcccagagccctctcaccctcacgcatctgctgtctggagggatggttggtaccgttctagggcagttcatgtgtccgctgtcctcagggcttcaggacatcaggtggggtctcgtgttcccagtgcagaggtagggcccagggcaaggggctggtgtcctgcacagctagtgtaggtgtagacagggccaccccagcgggtggctctgaagccagcccccctcacctcgcccccaaccatggccagagctcccttgttcttcagtctcccagtgatggtgtctgcaggcagcagtggagaatcctggcctggtgctgagtccaagttggcccctcctagtgctcggcacaccgagggcactttgctttcagaggaggacttgggactgaatcttacacctagagggtgaggaaccctttgcatgtttgtttgtttgtttgtttgttttttaattaaattttacagtacctattttgccttaaaaaaaaaaatctgttgaagggcatctgtcctccagcgttcgccacggcactgctcccagcagccaggatagaatcaacccaggtgtctgaccgcagatggatggataaggaaagtggggtgcacacactcagcagagtgctgttcagccttagaaagaatgagatcctggccaggcgtggtggctgtcgcctgtaatcccagcactttgtgaggccgaggcgggtggatcacctgaggtcaggagtttcagaccagcctggtcaacacggtgaaaccctttctctactaaaatacaaaaagtagccaggcgtggtggcgggcatctataattccagctactcaggaggctgaggcaggagaatcgcttgaacctaggaggttgaggctgcagtgagctgagtttgtaccactacgctccagcctgggcgacaacagcaagactccatc

SEQ ID NO: 67091 - DNA, 577 bp, Homo sapiens
ggaaccctttgcatgtttgtttgtttgtttgtttgttttttaattaaattttacagtacctattttgccttaaaaaaaaaaaaaaaaactaccttattcccactgctgggtgtgtttccagaagaaaggaagttactctgttgaagggcatctgtcctccagcgttcgccacggcactgctcccagcagccaggatagaatcaacccaggtgtctgaccgcagatggatggataaggaaagtggggtgcacacactcagcagagtgctgttcagccttagaaagaatgagatcctggccaggcgtggtggctgtcgcctgtaatcccagcactttgtgaggccgaggcgggtggatcacctgaggtcaggagtttcagaccagcctggtcaacacggtgaaaccctttctctactaaaatacaaaaagtagccaggcgtggtggcgggcatctataattccagctactcaggaggctgaggcaggagaatcgcttgaacctaggaggttgaggctgcagtgagctgagtttgtaccactacgctccagcctgggcgacaacagcaagactccatctc

SEQ ID NO: 67092 - DNA, 1094 bp, Homo sapiens
tttttttttgagaagagccagccttttgagagagcatatgactcttcctggactacaacagcttcttgtgtgaatcacagcccggcttttgccagttagtctgagtagataactacccacccccactcccccaagctgataattattaccctggtttatcctctgtctcatttcccctctcaagctgttagagaatgaatactgaatactgtggtgcactgctccatggatataaatgtaacagcagtaatatttacaaccaatgtctaattggctgtagcttgctttcagtgttcagtctaaaccataggactatatatttgtcttagcataatgccgaacatgcaagtctgcttaaactatagtcttaagatttgtgtgttttgggtttcctctacttcctctatttcctgtcttttttgggttataggtcagatgggttctactttttattcccatttcagactgtggagagcttctaaaaataccagtgtccatccctgcccctaggatctagttaatttttaaaagctctctgtgtttcaaatttgcatgtgtttctgtatgtttgcagtatctccgtgtgttttcaaatcttctgatggagcacttcgtgtactttaacccttggtctttccattgcctgtcccatttttaaattccctttttagtcttaatagctgcttgagttaggacctctggaagcaaaagtgggataggatgctgacggggaattgtaggcttgatggaagaggatgtttctatattaaatgtcatggcagatccagttctaggcatacctttaaaatgtatacacaggctgggcgtggtagctcactcctgtaatcccagcagtttgggaggcccaggcaggcggatcacttgaggtagggagttcgagaacagcctggccaacatggtgaaaccctgtctctactaaaaatacaaagattagctggacatgatggtgggtgcctgtagtcccagctgcttgggaggctgaggccggacaatctcctgaagctgggaggcggaggttgcagttagatgaactgacacaccactgcactccagcctgggagacagggtgacca

SEQ ID NO: 67093 - DNA, 447 bp, Homo sapiens
aggatgaagtaagtaaagagaaaatacgttgaatataatattttactgtggtaaaaaaacagcagaaataatctttggattcactggtatgattacttagatcctgaaatcctttacactttagattgctgttcaaaaagaaaaataatcacatgaaatcagtgaaaacctacaaagtacattctaatttttaaccataaatacagagtgtaaaaattgatgccagttatatttggaaatgtcaaaatacttatctaacaactaggaatgtgaatgtattttttgatgttaatttttcatatctttggggatttgggagccacattttattgataaaaactcatcaccggaacactttaaaataatgtttattttccaggccacaaatattgtatttcatttctatcagtaatcagatttattaaagacagcattatattaccatat

SEQ ID NO: 67094 - DNA, 307 bp, Homo sapiens
ccgcgcccggctgtctttcattttttagagacagggtctggttatgttgcccaggctggtctccaactcctggcctcaagtgatcctcccgccttgtcctcccaaagctctgggattataggcatgagctgctgtgcccagcttgttatttatttatttatagcctgagagagacttgaacatttatataagctgcagggaatggagaagtagatatactgaaaaccatgcaggccgggcacagtggctcacacctgtaaacccagcacattgggaggctgaggcgggtggatcacctgaggtcagg

SEQ ID NO: 67095 - DNA, 717 bp, Homo sapiens
ttctctctcactctctcactatgcatattgttcttttgtttttccacccgatccgtttaagagccaattacagacattacccaaagtatttctgtatttcctgaaaacaaggatatattctatgtcacagccacagtacaacccagcaaaatcaagaaattaataaatacaataataccatgtaacttacaatctcattcagctttcatcaaccattccagttgggtggaggctgatcatctctctgccattttcataagttatgtcatagattttcacatctgtcacatcattcatttctccaaagagccttagttccttttagtaaggaatggtatttagaagccaagtttggatgctaggtgtgtttattgctactgagatgtcattatttccagtctatttcagtgactagacctagcaaataaatgaatattgatatacacacccattcatctatatttctatgaaatatatttaaatatgtgtgcatatagatgtgtatatgtatatatagatctatgtatatgtgagcatatatatgtgcacatatatcaaaatatatatgtatatataaaatatgagttcacaccaatacctcaaattccaatccaataccacatattttcctctagtcttcctcttctctataattttacctcccttctgcaatagtaggaaacttgattctcattttccacaatatacttgtattct

SEQ ID NO: 67096 - DNA, 1790 bp, Homo sapiens
  misc_feature (1778)..(1778): n is a, c, g, or t
  misc_feature (1782)..(1784): n is a, c, g, or t
  misc_feature (1788)..(1790): n is a, c, g, or t
tgctatgaaaggatggggacctcaccagagaggactggtctcagcaatgtccttaagtggtcaaaacatgctgcggttgagtctccacccacatttgcacaaaggaccatcacctgtccttcctggaatctctaaagttttctgctttccttctgtcctgatggccagctctgctaagtcagctgagatgcccaccatctccaaaacccttaaccctactcctgatcctcatcaagaatatctggaccctaggattaccattgccttattcgaaattggatcacattccccttcctcctggggctctctccctttcctaaagaatagcagccatcaagttacagaacaacagactgcacagaagtttaacaatctcttaaaagaaattaaagatattcttaaaaatatggcaggttttgaagagaagatcacagaagcaaaagaactttttgaggaaaccaatattactgaggatgtgtcagcccacaaagaaaatatcagaggacttgacaaaatcaatgaaatgttatcaacaaacctgcctgttagtttagccccagagaaagaagacaatgaaaagaaacaggagatgatattggaaaccaatattactgaggatgtgtcagcccacaaagaaaatatcagaggacttgacaaaatcaatgaaatgttatcaacaaacctgcctgttagtttagccccagagaaagaagacaatgaaaagaaacagcagatgataatggaaaaccagaactctgagaacaccgcacaagtttttgcaagagatttggtaaatcgtttagaagaaaaaaaagtccttaacgaaactcaacaaagtcaggaaaaagcaaaaaacagacttaatgttcaagaagaaactatgaaaattaggaacaacatggagcagttactacaggaagcagaacactggagtaaacaacatactgagctcagtaaactgataaaatcctatcagaaatctcagaaagacataagtgaaactcttggaaataatggagtcggtttccaaacccagccaaataatgaagtgtcggctaagcatgagctggaggaacaggtgaagaaactgagccatgacacctattcattgcagttgatggcagctttgctagagaatgaatgccaaatcttacagcagagagtagagattctcaaggaactccatcatcagaaacagggaactctgcaagagaagccaattcagataaactataaacaggacaagaaaaatcagaagccatcagaagcaaagaaagtagaaatgtataagcagaacaagcaagcaatgaagggtacattttggaaaaaagacagatcctgtagaagcctggatgtttgtcttaataagaaagcttgcaatacccagttcaatattcatgttgcaagaaaagctcttaggggaaaaatgaggtcagctagcagcctaagatagaaaataccaaaagcagatgaaaaggtgaatccttaaaaaactacatctgttacctccaacttgtcagtcatgatcaatcatcaaaccttgggcagatctgctggttcaaccaagaaagagctatagaataaggagattgacacttatattactcattacttcagcagttatgtaagtctggtctttaatgaccattgtgtctacatcaagttcataacttttcacctttacaatctgcttgttttttttgtaattattagatagacagcctagagtgagaagttaaaggtccaattaagtaaagatctaaataaaaaccagaatncaannnaaannn

SEQ ID NO: 67097 - DNA, 1884 bp, Homo sapiens
  misc_feature (1872)..(1872): n is a, c, g, or t
  misc_feature (1876)..(1878): n is a, c, g, or t
  misc_feature (1882)..(1884): n is a, c, g, or t
agggccagagaataaacaccgggtgcctagaggagaagagatggagccccagccttggtcccctttcccacccttcctccccacaaggctgtctgagatgccaccttccacctaaacatcatctcccaaattttaatccttaactttggtctctgacttctgcttgattccacagtctccacccacatttgcacaaaggaccatcacctgtccttcctggaatctctaaagttttctgctttccttctgtcctgatggccagctctgctaagtcagctgagatgcccaccatctccaaaacccttaaccctactcctgatcctcatcaagaatatctggaccctaggattaccattgccttattcgaaattggatcacattccccttcctcctggggctctctccctttcctaaagaatagcagccatcaagttacagaacaacagactgcacagaagtttaacaatctcttaaaagaaattaaagatattcttaaaaatatggcaggttttgaagagaagatcacagaagcaaaagaactttttgaggaaaccaatattactgaggatgtgtcagcccacaaagaaaatatcagaggacttgacaaaatcaatgaaatgttatcaacaaacctgcctgttagtttagccccagagaaagaagacaatgaaaagaaacaggagatgatattggaaaccaatattactgaggatgtgtcagcccacaaagaaaatatcagaggacttgacaaaatcaatgaaatgttatcaacaaacctgcctgttagtttagccccagagaaagaagacaatgaaaagaaacagcagatgataatggaaaaccagaactctgagaacaccgcacaagtttttgcaagagatttggtaaatcgtttagaagaaaaaaaagtccttaacgaaactcaacaaagtcaggaaaaagcaaaaaacagacttaatgttcaagaagaaactatgaaaattaggaacaacatggagcagttactacaggaagcagaacactggagtaaacaacatactgagctcagtaaactgataaaatcctatcagaaatctcagaaagacataagtgaaactcttggaaataatggagtcggtttccaaacccagccaaataatgaagtgtcggctaagcatgagctggaggaacaggtgaagaaactgagccatgacacctattcattgcagttgatggcagctttgctagagaatgaatgccaaatcttacagcagagagtagagattctcaaggaactccatcatcagaaacagggaactctgcaagagaagccaattcagataaactataaacaggacaagaaaaatcagaagccatcagaagcaaagaaagtagaaatgtataagcagaacaagcaagcaatgaagggtacattttggaaaaaagacagatcctgtagaagcctggatgtttgtcttaataagaaagcttgcaatacccagttcaatattcatgttgcaagaaaagctcttaggggaaaaatgaggtcagctagcagcctaagatagaaaataccaaaagcagatgaaaaggtgaatccttaaaaaactacatctgttacctccaacttgtcagtcatgatcaatcatcaaaccttgggcagatctgctggttcaaccaagaaagagctatagaataaggagattgacacttatattactcattacttcagcagttatgtaagtctggtctttaatgaccattgtgtctacatcaagttcataacttttcacctttacaatctgcttgttttttttgtaattattagatagacagcctagagtgagaagttaaaggtccaattaagtaaagatctaaataaaaaccagaatncaannnaaannn

SEQ ID NO: 67098 - DNA, 306 bp, Homo sapiens
agtagtcagtcactcagaacaaagtgaagtcttttacaggggtgcagaatcataagcctggtccacaagaatcaaatgggccagactttgaattcagtcacccatttttagattatctgagccatcatgaaattgtttgtatttgtgtactacggaagatggggatttgctaatttcaagagacctcctggaattcatccacctccatccagctattcctgacctccttgtggggaagggagaagggaaggtcttaggaattaatctccagtaacatcactaccgaggtgagcaaggcaaacctgt

SEQ ID NO: 67099 - DNA, 672 bp, Homo sapiens
tttgtactgggatttaagacacccctgatggaatgaaagccaactgaaccacgtaaagctcgaaccacgtggcaagtggtggacaaaacttcaacgcatgatatttattggcacttcctcacctccctttgccctgcagctgtttttatgcttctttttctctccttgctaattactgactccccaagtggcaagttccgcagatagctgggttagaagagagacaggggagtgagctagtcaaatgtgaaaaatgctctcccagcaaagctgagacaaaattggagaagctgcagcctcacgcaccatccccctctttccaccagatggatgttgacttggtgtctgggagttcccgaaccctagagccaggatgttctgtttaatcaacagctcagccagctgcctgggagttttggcattaagccccgccttgaagggcgagctttaagtttttcccagttctggaactttctaccgagtatccaccacccttagacacaatcccagtgctacccgtctgacctgcactgctcatctgctttgtgtaacatgacccctgataagatgttgaaactgttattcacaaagactccgtgtttgggcaacatcaagactgtaagtgtagaattgagcaactgtcttctatcaataaaggctgaatggcaaaaa

SEQ ID NO: 67100 - DNA, 2871 bp, Homo sapiens
ttttttttgctttttgcagatttgaaatttaattaagctattaacttcttaatcatcacatcctccaactctgttttaactcccccctccccctcccctttttttttaaggaataaagggattcattcctcattttaactgatgttacagtgaagatgggttcttgaactcttggaagcctggatgagccacctaatctcaaagataaaaaccaaagaccaatgcgtattggggaaaagaatgcttagtactgcaagactgttgaatacctgttgaatattcctattgaggttttttcctaaacatacttcagtaacatcttaccggacaattgcactggagaaatgttgatccctggctggaatgtcataccattgacccatttgaagagttaaagctggatttgactgctctattctaccaggaatattgttagggtagccttttccagtttctaaacaattgtaatcatttattgactcagcaattcctcagataacaggtcaaaagatgtacagatacattctgaagttttcttgctattaaaggcacaagagtttccttgtattttgactgacaatgtagcatgtttccatttagtttgttagtgaggtggttttccctttgaaagccatttggtatattcaccataacaattagtttaatatgattacataagaaaactatgataaaacccagcaattttagtagttgtgaaaatacgttttttaaatcatgtttaagaagaattgcaagacttgaaaccaaatcctgatgggggaattctgtttaatcctgtttaatctgtttaatttctgtttaatccttagtttcttaacctgcatagcttatcctgtattgtactttttttcttttttaaactcccaaacaagaagcttgaaactttttctgtattttaaaattgaaatttggtcacagggtatagtcagatttttattaaggtttggtttgacaacctttaaagaaaggtttacctcgctaatacttcttaataacatgcatcaaatgatattccctatggtgaagtatatctcaaagttatgtatctttcatttttggcatttggtgcttatggacttagtacccaggcaacaaagatctattatcacctactctcttgtattcgctattatttcccaaaaaaaaaaaaggggcatatatcataagaataatattagaattattttgtttctcccacaagcccatggtagagatttctatgttcccattctccctttcactcagagttatgttgactgggggcggtggctcatttgggaagccaaggcgggtgaatcacttgaggtcaggagttcaagaccagctagccaatcacggcgaaactccgtctctactaaaaatataaaaattagtcccgtctctactaaaaatataaaaattagtcagacgtggtacctgtttggtggtgtgcatctgctagtcccaactactcgggacgctgaggcaggtgaattgcatgatccaggaggcagaggctgcaatgagctgagatcatgccactgcactccagcctgggtgacaagtgagactgtctcaaaaaaaaaaaaaaaaaaaaaaaaaaaaaaaacaagggtccttacttgcattaatgcatccacattattccatgtactcaccaggattttttgttataaacaaaaatacccactctggttacttattaaaagattatcagtcaatttacaaaaacaacaggaagatttacaaagaaaaaaaaaacaaaggaagcaagaacatccagaactcacagcacagaatactgtgcttaaaatgctgctgcaaggagtattaattaacttataccctactgtgacacttaacaggccaggtgtggtggctcacgcctgtatcccagcactttgggctgaaggcggagtacacttgaacccaggacagcctgggcaacatggtgagaccccgtgtctacaaaaaataaaaaagccgggagtggtggcaagctcctatagttccagctacttgggagactgaggtggagggatcacttcagcctgggaggtcaaggtcacagtgagctataatcaagccaccgcactctggcctgggcaacagagacagtctcaaaaagaaaaaaaaaaaagcacttaacacactttatgaatacaatatggcacatctatctgcccattagagtgagactcctgagtattttactcatctttccattctcaaatgcaaagagtatgtggcatataataactgtccgaatgtacgactgacatcttaaagcgtgtcggtcggcaaactttttcgtaaagggccaggtaagtaaacattataagctttgtaatccacacagtctctgttcaaaccattctactgttgtagcaggaaagcagccatggataatatgtaaacaagtcagctacgatgtgttcaaataaaactttataaaaacaggcagtaggctgggtttagcccatggaccacaatttgccaagtatttaacaagaatcaacacttttcctttcataatttaattgaagttggtacctacaaagatatgagctcactactacatatgactatctgtaatggatcaattttggatatgactttgggtgggggtaaaaaaagaaccgaagacatgtaatatagatgaataatgaaaataacagggctgggtgcagttgcctgcactttaggaggctgaggcaggagcatctctggaacctgggaggcagaggttgcagtgagccaagattgcgccattgcactccagccaaggggacaagagcaaaaacaaaaacaaaaacaaaaacctttaaggtaccagcctggctaagcagttaacatacctcactttatcag

SEQ ID NO: 67101 - DNA, 972 bp, Homo sapiens
cagtgagcggaaatcgcgccactgctcccccagcccgagaccctgtgtccctccctcgccccgtttctcccagcggtaacctccaaggagcggtaatggggggcccgcaggcccacatccgtgccggggaggccggtccgcacctgtgcgttcacagccccgcccctcccctcgcgccggggttacctggccgccactgaccactcatttctgtaacgtcatttcaaaatgttctgaaactggaatcgcagttatgtggcccacccagtatcttttgagtttggcttatttcattcagcatagaatgtggacgtgccccgggattgtatcagtgctttgcccctctgttgctgagccagtccgtggaatccatggaccaccctctctctagccaaggcctcaccccgcaaagagcatctaacgttttctttctttctttcttttctttccagaagccgccaccacgactggctaatttttttgtgtttcccttaccaataaagctgccataatgcccaggagtgcggttgctgggtcagatggtagatatatatatatgcctctctgtctctctctctctttctatgtatatatgtatgtttgtgtgtgtgtatatatatatatacacctatatagatatatgtgtgtgtatatgtatacacctatatagatgtatgtgtgtgtatatatacatatatatattatatatatactttttttttttttaaagaaactgtctaattgtttttcagagtggctgggccattttgcatccctacggtgatgcagattttccgcatcctcaccagcatttggtggagttgctgtttttcattttagccgcgtcctggtagggatgtgctggcagggtgctgtggtcctcattcgcgtttccctgttggccagtgacgtggagcatctttctttgtgcttatttgccatctgtgggttttcttggtgaaatctctctta

SEQ ID NO: 67102 - DNA, 1860 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67103 - DNA, 2067 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactagatggggtttcaccgtgttggccaggctggtctgaagctcctgacctcgtgatctgcccacctcagcctcccaaagtgctgggattacagactgtcactgcgacacccaggctggagtgcaatggcgtgatctcggctcactgcaacctccgcttcccgggttcaaccgattctcctgcctcagcctctcgagtagctgggactacggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67104 - DNA, 2057 bp, Homo sapiens
cgtgggtcactgcacccgtcgtatcctggggtcaagcaattctcctgccttagtcttccgagtatttcgggactacatgcacgtgccaccagcacttgagctaacttatttgtatttattagatagagatggggtttcaccgtgttggccaggctggtctgaagctcctgacctcgtgatctgcccacctcagcctcccaaagtgctgggattacagactgtcactgcgacacccaggctggagtgcaatggcgtgatctcggctcactgcaacctccgcttcccgggttcaaccgattctcctgcctcagcctctcgagtagctgggactacggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67105 - DNA, 2056 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggcctcgacagacggggaaactgaggctcagggaggggcgcggcggtggtcgggcggggccgcgcgctccttcgcgtgacaagctcggcgccacccgttcccccgcgacggctgccgcccctgcagggtcgcccggcgcctgcccattagcgattaccgaactatcgaaatcatcaatcatcgattcccatgaatcggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67106 - DNA, 2482 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagagtgagctggggtccccataagcccatccctccctgttgtcagcagggtccgagcatccagaaagtgcttctgcctctgtgcccctcctgaggcagcaggcggggtggctgggaaccagacatgcccgctgggccgccagctccagggcagtggcccacctcaatgaccagctgggcttgggtcagtctggggttttcccgggtaagaaactctccacgaggagtctggcaggcagaggcctggtgttcagctgtgaccccgggcaggtgggcaggagcagggcgggcagggtgctgacggctgggccacacgctgtctcattgtctctgcagtccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctaggtgggtgcccacagagacccgcaggggttctgggctgtgggcgcaggagccacttcatgctcttcccgggtcagggagcccactgctgggcgtggctaaaagagcatcccctcaccccaggcctccctggcctctctggagttgttcagtctcttcccagagcacatctgaacattttcatcttccagttgcagctggcgtggggctctcgcctgtaatcccagtacttaagaggctgatgggggagaagcactgtaggccaggagttcaagaccagcctgggcaacatacctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67107 - DNA, 1962 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagttgcagctggcgtggggctctcgcctgtaatcccagtacttaagaggctgatgggggagaagcactgtaggccaggagttcaagaccagcctgggcaacatacctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67108 - DNA, 2040 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagagtgagctggggtccccataagcccatccctccctgttgtcagcagggtccgagcatccagaaagtgcttctgcctctgtgcccctcctgaggcagcaggcggggtggctgggaaccagacatgcccgctgggccgccagctccagggcagtggcccacctcaatgaccagctgggcttggtccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67109 - DNA, 1444 bp, Homo sapiens
gcctaggtgaggctggtgttaatcggcgagggtcaagacagcctgggcacatacctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67110 - DNA, 1223 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcagaacatggaggtcaccgatgcttgaacattcctgcctccctatttgccaggctttcatttctgtctgctgagatctcagagcctgcccaacagcagggtaaggctcccgaaggatcctcaatcacc

SEQ ID NO: 67111 - DNA, 1382 bp, Homo sapiens
cccgatagcccgacagtaggagggtcggtgtgagttatccttgaagcttaagactcgggcccgagatggagtcagatgtcaggtgcggatcttggctcgagtattagcaaatattctaacgagaacttagaatgtggaatgggataacgggttccaagtgaacagtcatggaacttggttctgtcggtctagtcggggccccgactagcctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67112 - DNA, 941 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagtggggtggggcgggtggagcagcagcccggtggcctctgtccctagtcagggctgctgccgggagcaggagcgaaggcgtccatccaggctttgcttggctcctggggtcagcgggggctgaaggaacagaagcgtggttgagtgctcaggaaccgctcccatgcggcgggcgccaccacccgctgggatctggaagttgcccctgcgtcacccctgctgtggccgggaggcctctgtggtcaggcaggtggcactgactcccaccc

SEQ ID NO: 67113 - DNA, 957 bp, Homo sapiens
actttttcatcacccctaaaagaaacctgtccccacagcagccacctgccgtctccccctccctgagccctgacggccaggaatgcacttcccatctctggacttgcctgttgtagactgttgtagacgcttagagaaacggatgcattcaccgtgcccctgccctgcttttccaggtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67114 - DNA, 656 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactaagccgccaccacgactggctaatttttttgtgtttcccttaccaataaagctgccataatgcccaggagtgcggttgctgggtcagatggtagatatatatatatgcctctctgtctctctctctctttctatgtatatatgtatgtttgtgtgtgtgtatatatatatatacacctatatagatatatgtgtgtgtatatgtatacacctatatagatgtatgtgtgtgtatatatacatatatatattatatatatactttttttttttttaaagaaactgtctaattgtttttcagagtggctgggccattttgcatccctacggtgatgcagattttccgcatcctcaccagcatttggtggagttgctgtttttcattttagccgcgtcctggtagggatgtgctggcagggtgctgtggtcctcattcgcgtttccctgttggccagtgacgtggagcatctttctttgtgcttatttgccatctgtgggttttcttggtgaaatctctctta

SEQ ID NO: 67115 - DNA, 476 bp, Homo sapiens
catggaccaccctctctctagccaaggcctcaccccgcaaagagcatctaacgttttctttctttctttcttttctttccagaagccgccaccacgactggctaatttttttgtgtttcccttaccaataaagctgccataaaatgttgtatacaggtttttgtgtgaacatacatttccattcttctgggataaatgcccaagagtgcggttgctgggtcacatggtagatatatatatatgcctctctgtctctctctctctttctatgtatatatgtatgtttgtgtgtgtgtatatatatatatacacctatatagatatatgtgtgtgtatatgtatacacctatatagatgtatgtgtgtgtatatatacatatatatattatatatatactttttttttttttaaagaaactgtctaattgtttttcagagtggctgggccattttgcatccctacggtgatgcagatt

SEQ ID NO: 67116 - DNA, 938 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgacctgaggccaggaccggtcatgcactgcttcgaacttccggcatttttattcatgctctccgggctcttcccgggccggtccccccacggcccacgggggtctttg

SEQ ID NO: 67117 - DNA, 1979 bp, Homo sapiens
cagaggcctctggggtgggatcgcgggccgtaagtggctgtggagctggggtcactgcgcggtgggaccatggcctcggagaagccgctggcggcagtcacttgtacagcgccggtcaacatcgcggtcatcaagtactactgtcactgcgacacccaggctggagtgcaatggcgtgatctcggctcactgcaacctccgcttcccgggttcaaccgattctcctgcctcagcctctcgagtagctgggactacggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67118 - DNA, 2192 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagagtgagctggggtccccataagcccatccctccctgttgtcagcagggtccgagcatccagaaagtgcttctgcctctgtgcccctcctgaggcagcaggcggggtggctgggaaccagacatgcccgctgggccgccagctccagggcagtggcccacctcaatgaccagctgggcttgggtcagtctggggttttcccgggtaagaaactctccacgaggagtctggcaggcagaggcctggtgttcagctgtgaccccgggcaggtgggcaggagcagggcgggcagggtgctgacggctgggccacacgctgtctcattgtctctgcagtccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67119 - DNA, 2289 bp, Homo sapiens
ttggctaatttttgtatttttaatagagatggggtttcaccgtgttggccaggctggtctgaagctcctgacctcgtgatctgcccacctcagcctcccaaagtgctgggattacagactgtcactgcgacacccaggctggagtgcaatggcgtgatctcggctcactgcaacctccgcttcccgggttcaaccgattctcctgcctcagcctctcgagtagctgggactacggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagagtgagctggggtccccataagcccatccctccctgttgtcagcagggtccgagcatccagaaagtgcttctgcctctgtgcccctcctgaggcagcaggcggggtggctgggaaccagacatgcccgctgggccgccagctccagggcagtggcccacctcaatgaccagctgggcttgggtcagtctggggttttcccgggtaagaaactctccacgaggagtctggcaggcagaggcctggtgttcagctgtgaccccgggcaggtgggcaggagcagggcgggcagggtgctgacggctgggccacacgctgtctcattgtctctgcagtccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67120 - DNA, 2117 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctaggtaccttttgttgcccttgtcgcgggccgcaagctctgcaggccgtgaacagagagtgtccgagagtggaactagcggaggtgggggacagacggctgggccggtgaatgctggcctcaaaggctgatggcccagaagccctgtcatctggaaatccccatttgccgtggggtgtgggacgttcctggggcggtgagctgtcagggagcacagcgcaggcagctctgaggaccctccctgaatccgcatgcctgcagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67121 - DNA, 1416 bp, Homo sapiens
  misc_feature (1226)..(1226): n is a, c, g, or t
  misc_feature (1228)..(1228): n is a, c, g, or t
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcaatgccatctcctggcgcatcatccacctggtgcaccgcttcaacgcccaccacggggacaccaaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcagggctaatctggtgacctggncnctctggcctgagctcgaagcagtgctgatgctcaaggacgatgcgtgggaagggggccccgggtgggggtgtgggtgcggccggactttggtggtccggctggttttgggggggagtgtgcgaaaccggagcgcgcttagcgcgttaagggggacgaggttgcgttcggtttttgtttgttacggttg

SEQ ID NO: 67122 - DNA, 1053 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggggcaagcgcgatgaagagctggttctgcccatcaactcctccctgagcgtcactctgcaccaggaccagttaaaaaccaccacaacagccgtcatcagcaaggacttcaccgaggaccggatttggctgaatggccgggaggaggatgtggggcagccgaggctgcaggcctgcctgcgggagatccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagcgctgagaagaagctgacaggcagtaccgtgggcatgcgggccagtgtggagaccagccccctgcttcggttccgggccgagtccgtggtgcccgcgcgcatggcggagatggcccgctgcatccgggagcgagacttccccagcttcgcccagctgaccatgaaggacagcaaccagttccacgccacctgcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67123 - DNA, 1075 bp, Homo sapiens
ggttcacaggcagacgtgtcaagtaccaggcacttggggtcacagctccactccagtgtggccctgagggcctagactgagctcttggagagcccaaggccgcctggcagaccagagggttggggagacaagggtcaggcaccacgtgaatagccagggtgactgctgtgggttccaggtggcgtacacctttgacgcgggccccaatgccgtgatcttcaccctggacgacactgtggctgagtttgtggctgctgtgtggcacggctttcccccaggctcgaatggagacacgtttctgaaggggctgcaggtgaggccggcccctctctcagctgagcttcaggctgcgctggccatggagccgacccccggtggggtcaaatacatcattgtcactcaggtggggccagggcctcaaatcctggatgacccctgcgcccacctcctgggtcctgacggcctgccgaagccagctgcctgactgcctcagcagggaccgcatgccgcttggagaaggggtggcctcgccggagctagggagcggatgtggtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcactgtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattgctgcctccgga

SEQ ID NO: 67124 - DNA, 852 bp, Homo sapiens
taggctaggtagaggccgggtgtgaatcggccgagtgtggagctggggtcactgcgcggtgggaccatggcctcggagaagccgctggcggcagtcacttgtacagcgccggtcaacatcgcggtcatcaagtactggcctcgacagacggggaaactgaggctcagggaggggcgcggcggtggtcgggcggggccgcgcgctccttcgcgtgacaagctcggcgccacccgttcccccgcgacggctgccgcccctgcagggtcgcccggcgcctgcccattagcgattaccgaactatcgaaatcatcaatcatcgattcccatgaatcaagccgccaccacgactggctaatttttttgtgtttcccttaccaataaagctgccataatgcccaggagtgcggttgctgggtcagatggtagatatatatatatgcctctctgtctctctctctctttctatgtatatatgtatgtttgtgtgtgtgtatatatatatatacacctatatagatatatgtgtgtgtatatgtatacacctatatagatgtatgtgtgtgtatatatacatatatatattatatatatactttttttttttttaaagaaactgtctaattgtttttcagagtggctgggccattttgcatccctacggtgatgcagattttccgcatcctcaccagcatttggtggagttgctgtttttcattttagccgcgtcctggtagggatgtgctggcagggtgctgtggtcctcattcgcgtttccctgttggccagtgacgtggagcatctttctttgtgcttatttgccatctgtgggttttcttggtgaaatctctctta

SEQ ID NO: 67125 - DNA, 472 bp, Homo sapiens
agctgttggggacctccctgggggtggccttgcttacccagctgtgcggaacaggcttggttgggagtgcctggcctcaccctttgtggggaaaccagattctctgggcagcagtggtaaatggtgtctgagtctgtgtttcgttggatgtgtctgaggtccgctgctgccagctgggttatgctgtctccaaagctatctgcagtgggggaggccctgagcctgggcaggggagggtacagaggcctcaacccatgggacctgggggtgatctgaactctgcacttcactttttttcaggatttcccccgccccaccctaaaggaggaggaaatagagtctgtcccaccctaagccccagtccctctccccaggtctctttggcatctcccagctgggctggggctgaaggcccttctctggggttggccacagtgaggccaggatctggctgggcaggtggcagtgttca

SEQ ID NO: 67126 - DNA, 732 bp, Homo sapiens
agcatattagtctatcaaatccaactacccttaatgccagtgaatgttaaaagtaaaactttcttagcactgacaatttaataagtaaaaataaatggtactaagcttacaaaaattagctgaattggggaaattgttgataaggccacaagtattaacatgttatacttgcttgctttgagggtatatagcatcttttggcaaagtgttacattattgtgaatttaacagtgaaagtttaagccagtctaggatttcaaagtttataactttactaccaggaaattaatttacttaaatatgttctttgtttccatcaatgtcaacatctgaaattccactggagaagtattagctttggcctactaaaagcaaaatgacaagaagcaagaatgcaagccagcatcaaaaattggtctcctgttttgagattaccccgagtctttctgggggtatcatttatataagtctaattttcgggattcaggcaagagctggccattgttgtgctagctgggcctccagtggaatgtaaaatgataatgaagattgaactgaggtagaaaaatgaatttaccttagaaaggacaccaaagatttgattagtattccacatagttgccatacgtatttaattgcagactaggaatttttcttgctttaaactattagattcttttacagacaaagatataagcaagccaagcattaaaaagccaaaaaggtgctgct

SEQ ID NO: 67127 - DNA, 363 bp, Homo sapiens
caggcatggtggcaggtgcctgtagtcccagctactcgagaggctgaggcaggagaatggcatgaacccgggaggcagagtttgcagtgagctgagatcgcaccactgcactccagctggggcaacagagtgagactccacctcaaaaaaaaaaagaaaagaaaagaatcagtgaacttgaagacagacaatagggattcctgtgtttgtttcttattgttctcacaacaaattacctcaaatttagaagcttaaagtattacacattttttatcttacagttctgtaggtcagaagtgctaaaatcaaggtgttggaagggctgtattcttttctggagacaccaggaaagaatccttttca

SEQ ID NO: 67128 - DNA, 1033 bp, Homo sapiens
tccattggtcttcaccagtagttctgcagtggggatctgcacttctgggcttcagcacacatcagtgtggttcacgtgtttcctgctgttatgaaagagattggagaggactaagcttggaattgcctgtcccacagcaagaggctatggagctgggccacggagcagggcccatctgaatgacaaggagggccaacaggacttggacccctggaaagcggcctacagttccttggacacctccaagttcaagaaccagggtctgtcatccccacagcccctgcccctgggatccagcactcaaggcagctccctagggcagtgccacttgaaggagattccccctccacccccgactgctgccagcagggattctctgggcatggacccacagtccaggtccctgaagaatgcgggctctcgatcctcctcgagagagaacagggccacctcgggagagggggctcagccatgccaggggacggatgacggtcccagacttgggggctcaggaccagaggagcacgcccacgaaccagaagggcagcatcattcctaacaacattcgccacaagtttgggagcaatgtggtggaccagctggtctccgaggagcaggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtcttctactcaaataaagtgctaacaataaggaaaggctcaaa

SEQ ID NO: 67129 - DNA, 865 bp, Homo sapiens
accagtagttctgcagtggggatctgcacttctgggcttcagcacacatcagtgtggttcacgtgtttcctgctgttatgaaagagattggagaggtgaggcagagacttatgaagggccagggttcttccaggacatggggtttcatcttccttctccccattcagagttgcttgtgagtgaagactgcctagactggacttaccttcccgccctctttgaccaaagtctcttgggatctctctctctgggtcagaaactggaagtgagtccacacttccattgtagcccgtccagactgctgtggactggcagtgcactgggacgtacagagctgccgtgggcacgtcaggttggtggctggggataggaggagaaagaaaacttggagctaacttgaacttcacctagcttgaagatgtgcaatttaattttagccccacctggtgaagtcctgtgtcttttcggagcctcattttctccatctgtgaaagaagataaattagtagtgtctccgaacaccttactgggtatttgtgaagaccagactaatttaccagatgtgagaatgcttgacatggacttgtgttagttatctcttgctgcacaacaaatcaccccaaaacttagtgggcttaagacaacatttactatctcacagtttctgtgagttgggaataccggtggagtgttggtgatttttctgtcccagggtctctcacaggctgcaatcaaggtgttgcttgggtctctagtctcatctcaaagctcgaccagagaaggaacccattcacatggcaggatccagctactctggagctgttggcaagaggccactctgagttccttgccctgtggacctctc

SEQ ID NO: 67130 - DNA, 1052 bp, Homo sapiens
tccattggtcttcaccagtagttctgcagtggggatctgcacttctgggcttcagcacacatcagtgtggttcacgtgtttcctgctgttatgaaagagattggagaggactaagcttggaattgcctgtcccacagcaagaggctatggagctgggccacggagcaggtacaaccactttcaccagggcccatctgaatgacaaggagggccaacaggacttggacccctggaaagcggcctacagttccttggacacctccaagttcaagaaccagggtctgtcatccccacagcccctgcccctgggatccagcactcaaggcagctccctagggcagtgccacttgaaggagattccccctccacccccgactgctgccagcagggattctctgggcatggacccacagtccaggtccctgaagaatgcgggctctcgatcctcctcgagagagaacagggccacctcgggagagggggctcagccatgccaggggacggatgacggtcccagacttgggggctcaggaccagaggagcacgcccacgaaccagaagggcagcatcattcctaacaacattcgccacaagtttgggagcaatgtggtggaccagctggtctccgaggagcaggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtcttctactcaaataaagtgctaacaataaggaaaggctcaaa

SEQ ID NO: 67131 - DNA, 695 bp, Homo sapiens
tccattggtcttcaccagtagttctgcagtggggatctgcacttctgggcttcagcacacatcagtgtggttcacgtgtttcctgctgttatgaaagagattggagaggactaagcttggaattgcctgtcccacagcaagaggctatggagctgggccacggagcaggtacaaccactttcaccagggcccatctgaatgacaaggagggccaacaggacttggacccctggaaagcggcctacagttccttggacacctccaagttcaagaaccagggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtcttctactcaaataaagtgctaacaataaggaaaggctcaaa

SEQ ID NO: 67132 - DNA, 495 bp, Homo sapiens
ttccgggggggaggggcggcgaggcgaggcctgcggagcggaggaagacaaacataaagatgaagtgcttaattcaaggtcacacaatgtcggggatggacctccagatttccttactgaaaacaagctcagggctcccactgattgtacattatggtgagacgtggtcttgtaacacagtggttaagaatgtgactttggagccagcctgctaggggctgaattctgactcagccatttactaactgtgtgaccttaggtaagtcatttaccttctttgtccctcagtttcatctcggttaagtagggataatgatagcacctattttatagggttattgtgaggaataaatccaagtaaaatgcttagaatagtaactgaaacatagcactcattaggaatgctttaattttcatttatttgagtattaaaggttgaattttcagaggtattttggacctttgtattttttctttaaatcacttattcatgac

SEQ ID NO: 67133 - DNA, 3820 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccggtgaatcttattaatagtttaccacaattaagtgttcatttttagtctagaagggacaggcgtttattgtgcattggccagtgccagcacatccgatgcaaggcagttcaccgtattctatctttaatttttaccatggtcctctgaggtaggtgttcttatctctctctctctctctctcttttaaacaaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggttggttgaggggtttaacaaggctaagaaggtgagacgtggtcttgtaacacagtggttaagaatgtgactttggagccagcctgctaggggctgaattctgactcagccatttactaactgtgtgaccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataacaggcagccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagacaaaaaaaagcat

SEQ ID NO: 67134 - DNA, 3766 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccggtgaatcttattaatagtttaccacaattaagtgttcatttttagtctagaagggacaggcgtttattgtgcattggccagtgccagcacatccgatgcaaggcagttcaccgtattctatctttaatttttaccatggtcctctgaggtaggtgttcttatctctctctctctctctctcttttaaacaaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggttggttgaggggtttaacaaggctaagaaggtgagacgtggtcttgtaacacagtggttaagaatgtgactttggagccagcctgctaggggctgaattctgactcagccatttactaactgtgtgaccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataacaggcagccttccctgctcctgtgtctttatttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagacaaaaaaaagcat

SEQ ID NO: 67135 - DNA, 3630 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccgaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggttggttgaggggtttaacaaggctaagaaggtgagacgtggtcttgtaacacagtggttaagaatgtgactttggagccagcctgctaggggctgaattctgactcagccatttactaactgtgtgaccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataacaggcagccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagacaaaaaaaagcat

SEQ ID NO: 67136 - DNA, 3410 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaagacttcctagcatgggctgttgtgctggagagaacgagagctacgaagagactacagtgcctctgactttttcataggacagttggccgaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggttggttgaggggtttaacaaggctaagaaggtgagacgtggtcttgtaacacagtggttaagaatgtgactttggagccagcctgctaggggctgaattctgactcagccatttactaactgtgtgaccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataacaggcagccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagacaaaaaaaagcat

SEQ ID NO: 67137 - DNA, 3330 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccggtgaatcttattaatagtttaccacaattaagtgttcatttttagtctagaagggacaggcgtttattgtgcattggccagtgccagcacatccgatgcaaggcagttcaccgtattctatctttaatttttaccatggtcctctgaggtaggtgttcttatctctctctctctctctctcttttaaacaaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggttggttgaggggtttaacaaggctaagaaggtgagacgtggtcttgtaacacagtggttaagaatgtgactttggagccagcctgctaggggctgaattctgactcagccatttactaactgtgtgaccttaggctggagtgcaatggcatgatctcggctcatcacaacctctgcttcctgggttcaagcgattctcctgcctcagcctcccgagtacctgggactacaggcactcgccaccatgcccggctgatttttgtatttttaatagagatggtttcactatgttggccaggctggtctcgaactcctgaccttgtgatctgcccacctcagcctcgaaaagtgctgggattacaggcgtgagccactgcgcccagccttgtattttttttcagtttgggtagctgtccctaattcatttgttaaaggagaagcaagagcaagaacctttaatctgttctcctcttccctaatttgaaagtagcttgttattttgaatatcactttctctgaaatagcacatctccatctcagagaatggatttaatgtttggatacagccaaaagtcatttcattaccaaaccatggggtgaatataccatgtaaagcagtttgggatcagaactcacagtctgaattgtaagtgatgagactgctgtctctctgctacagcttcttggctggctctgaaggctctttgaaggcagatcctaacaaggggactgctttgaagggccattgttcatttggaatgataaagtctatgttgttcaaaaaacaaatgcttgtagcaggtattttttcactccagactgagaatattggtgggatattgataaggggtactgaatggtaataaacatgtgctctagctctgtgctagtcagcttatttcagaactctagtttgattcagtttcttgcctctgactcaaaatggagggagagtgatttttacataagagaacacacccacatatccttttggcagcagctacctgccagagatgttgaagaagagtagccaacctttacacagcagatattgtgtgccagtcatagtcctaagtataataccttacatgtataaacttcttataaggttggtgctctgtaccgaattgaatagtatcccccaaaattcatgttgtcccagaacctatgaaagtgatcttacttgagggaggggggaggggggagggatagcattaggagatatacctaatgctaaatgacgagttaatgggtgtagcacaccagcatggcacatgtatacatatgtaactaacctgcacattgtgcacatgtaccctaaaacttaaagtataataataataaaataaaaaaaaaaaagaaagtgatcttacttggaaataaggtctttgcacatatgatcaagttgagatgaagttgtactggaaagtctgtctagtgactggtgttgtcataagaagagagggacacagagggaagatggccacatgaagatggaggcagagattgcagttatgctgctgcaaactaaggaatggctctggccctccaaggattgctgataaccaccagaaactagaagagacaaggaaggattcttccctagagccttcagagggagcatggccctactgacacctggatttcaaacttgtagcttcctaaactgcaagagaataaatttctgttgttttaagccaaataaaaag

SEQ ID NO: 67138 - DNA, 2570 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccgaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacagaaaacaagctcagggctcccactgattgtacattatggtgagacgtggtcttgtaacacagtggttaagaatgtgactttggagccagcctgctaggggctgaattctgactcagccatttactaactgtgtgaccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataacaggcagccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagacaaaaaaaagcat

SEQ ID NO: 67139 - DNA, 2596 bp, Homo sapiens
ttccgggggggaggggcggcgaggcgaggcctgcggagcggaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacagatggagtcttgctgtgtcaccaggatggagtgcagtggcgcaatctcggctcactgcaacctctgcttcccgggttcaagtgattctcctgcctcagcaacccgagtagctggcactacaggaaaacaagctcagggctcccactgattgtacattatggtgagacgtggtcttgtaacacagtggttaagaatgtgactttggagccagcctgctaggggctgaattctgactcagccatttactaactgtgtgaccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataacaggcagccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagacaaaaaaaagcat

SEQ ID NO: 67140 - DNA, 2203 bp, Homo sapiens
gtgagccaccacacttggtcttaagcaaatattaactccaatcactatcctaagccaaggtgtctgagcagctgagggaggaccagagtgaatgcagctagtgccacactgaacaaaccactcttgctcattccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataacaggcagccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagacaaaaaaaagcat

SEQ ID NO: 67141 - DNA, 2168 bp, Homo sapiens
agttacactctctacaagggtaaagcaaactgggaggtgctggttctggctccagagggactggggtctggggcctgtcacctggtcctgcctgtgtttcctgggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataacaggcagccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagacaaaaaaaagcat

SEQ ID NO: 67142 - DNA, 3326 bp, Homo sapiens
  misc_feature (3174)..(3174): n is a, c, g, or t
  misc_feature (3184)..(3184): n is a, c, g, or t
  misc_feature (3326)..(3326): n is a, c, g, or t
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccggtgaatcttattaatagtttaccacaattaagtgttcatttttagtctagaagggacaggcgtttattgtgcattggccagtgccagcacatccgatgcaaggcagttcaccgtattctatctttaatttttaccatggtcctctgaggtaggtgttcttatctctctctctctctctctcttttaaacaaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggttggttgaggggtttaacaaggctaagaaggtgagacgtggtcttgtaacacagtggttaagaatgtgactttggagccagcctgctaggggctgaattctgactcagccatttactaactgtgtgaccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggctcccaacacacatacacatacagagaattttgtctcaattagataattaacttctgcttggttgtaaaccaaaccactggttcttaaactttcattggatcattttattgaagaattaaatagtgtggttctggcctaatgtctgaagcttcanagagtgatangcttgtataacagcagcttcctgtctggcttataatcataactgagagcaacttctagcctacagattgtgagctagaagtgaaccgaggaagactgcgtgaactctatctacagacaagcgtgtgcagcactactatctcn

SEQ ID NO: 67143 - DNA, 2004 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccggtgaatcttattaatagtttaccacaattaagtgttcatttttagtctagaagggacaggcgtttattgtgcattggccagtgccagcacatccgatgcaaggcagttcaccgtattctatctttaatttttaccatggtcctctgaggtaggtgttcttatctctctctctctctctctcttttaaacaaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggtgagacgtggtcttgtaacacagtggttaagaatgtgactttggagccagcctgctaggggctgaattctgactcagccatttactaactgtgtgaccttagtctgtctagtgactggtgttgtcataagaagagagggacacagagggaagatggccacatgaagatggaggcagagattgcagttatgctgctgcaaactaaggaatggctctggccctccaaggattgctgataaccaccagaaactagaagagacaaggaaggattcttccctagagccttcagagggagcatggccctactgacacctggatttcaaacttgtagcttcctaaactgcaagagaataaatttctgttgttttaagccaaataaaaag

SEQ ID NO: 67144 - DNA, 2015 bp, Homo sapiens
ttcggcacagggcgaggctgcggagaggaagacaaacataaagatgaagtgcttaattcaaggtcacacaatgtcggggatggacctccagatttccttactgaaaacaagctcagggctcccactgattgtacattatgagacggagtcttgctatgttgcccaggctggtcttgaactcctcacctcaagcgatcctcccgtcttggcctcccaagtgtcaggattacgggcatgtgctatcacacccaacctgatacattgcctttataaatttttttttctttattctaaaaaccagaaaaaacaaaactggatacatgtgcagaacatgcaggtgagacgtggtcttgtaacacagtggttaagaatgtgactttggagccagcctgctaggggctgaattctgactcagccatttactaactgtgtgaccttaggctggagtgcaatggcatgatctcggctcatcacaacctctgcttcctgggttcaagcgattctcctgcctcagcctcccgagtacctgggactacaggcactcgccaccatgcccggctgatttttgtatttttaatagagatggtttcactatgttggccaggctggtctcgaactcctgaccttgtgatctgcccacctcagcctcgaaaagtgctgggattacaggcgtgagccactgcgcccagccttgtattttttttcagtttgggtagctgtccctaattcatttgttaaaggagaagcaagagcaagaacctttaatctgttctcctcttccctaatttgaaagtagcttgttattttgaatatcactttctctgaaatagcacatctccatctcagagaatggatttaatgtttggatacagccaaaagtcatttcattaccaaaccatggggtgaatataccatgtaaagcagtttgggatcagaactcacagtctgaattgtaagtgatgagactgctgtctctctgctacagcttcttggctggctctgaaggctctttgaaggcagatcctaacaaggggactgctttgaagggccattgttcatttggaatgataaagtctatgttgttcaaaaaacaaatgcttgtagcaggtattttttcactccagactgagaatattggtgggatattgataaggggtactgaatggtaataaacatgtgctctagctctgtgctagtcagcttatttcagaactctagtttgattcagtttcttgcctctgactcaaaatggagggagagtgatttttacataagagaacacacccacatatccttttggcagcagctacctgccagagatgttgaagaagagtagccaacctttacacagcagatattgtgtgccagtcatagtcctaagtataataccttacatgtataaacttcttataaggttggtgctctgtaccgaattgaatagtatcccccaaaattcatgttgtcccagaacctatgaaagtgatcttacttgagggaggggggaggggggagggatagcattaggagatatacctaatgctaaatgacgagttaatgggtgtagcacaccagcatggcacatgtatacatatgtaactaacctgcacattgtgcacatgtaccctaaaacttaaagtataataataataaaataaaaaaaaaaaagaaagtgatcttacttggaaataaggtctttgcacatatgatcaagttgagatgaagttgtactggaaagtctgtctagtgactggtgttgtcataagaagagagggacacagagggaagatggccacatgaagatggaggcagagattgcagttatgctgctgcaaactaaggaatggctctggccctccaaggattgctgataaccaccagaaactagaagagacaaggaaggattcttccctagagccttcagagggagcatggccctactgacacctggatttcaaacttgtagcttcctaaactgcaagagaataaatttctgttgttttaagccaaataaaaag

SEQ ID NO: 67145 - DNA, 1404 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaagacttcctagcatgggctgttgtgctggagagaacgagagctacgaagagactacagtgcctctgactttttcataggacagttggccgaggaagacaaacataaagatgaagtgcttaattcaaggtcacacaatgtcggggatggacctccagatttccttactgaaaacaagctcagggctcccactgattgtacattatgagacggagtcttgctatgttgcccaggctggtcttgaactcctcacctcaagcgatcctcccgtcttggcctcccaagtgtcaggattacgggcatgtgctatcacacccaacctgatacattgcctttataaatttttttttctttattctaaaaaccagaaaaaacaaaactggatacatgtgcagaacatgcaggtttgttacatagctgtacgtgtgccatggtggtttgctgcacctattgacctatcctgtaagttccctcccctcacccccaccccccaacagccctgaagtgtcaacg

SEQ ID NO: 67146 - DNA, 247 bp, Homo sapiens
ttccttttgggtaccacatccttccccactctcagaccagattctggtgggataagtcccttggaggacacatgactgtggtcagagaatagcaattgacgtgggcatggttccaaatccaggccaatcacgactctggatttctgttggaactgttaagaaagtgacctcatttcttttccaggtgggttcccaagcctgtaaaatgtaagccttatgctgctgagggccatcttgccaccctgag

SEQ ID NO: 67147 - DNA, 3767 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccggtgaatcttattaatagtttaccacaattaagtgttcatttttagtctagaagggacaggcgtttattgtgcattggccagtgccagcacatccgatgcaaggcagttcaccgtattctatctttaatttttaccatggtcctctgaggtaggtgttcttatctctctctctctctctctcttttaaacaaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggttggttgaggggtttaacaaggctaagaaggtgagacgtggtcttgtaacacagtggttaagaatgtgactttggagccagcctgctaggggctgaattctgactcagccatttactaactgtgtgaccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggctcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataacaggcagccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagacaaaaaaaagcat

SEQ ID NO: 67148 - DNA, 3322 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaagaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggttggttgaggggtttaacaaggctaagaaggtgagacgtggtcttgtaacacagtggttaagaatgtgactttggagccagcctgctaggggctgaattctgactcagccatttactaactgtgtgaccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataacaggcagccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagacaaaaaaaagcat

SEQ ID NO: 67149 - DNA, 3013 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtgaggaagacaaacataaagatgaagtgcttaattcaaggtcacacaatgtcggggatggacctccagatttccttactggtgagacgtggtcttgtaacacagtggttaagaatgtgactttggagccagcctgctaggggctgaattctgactcagccatttactaactgtgtgaccttagggaggaggacctggttgatagaagaatttatctcgtagtcttaacatccactgtaattccaaactttgaggacgatagagatcagtgggctttgactgcccagcatgcagtctccattcttaggtgggttcccaagcctgtaaaatgtaagccttatgctgctgagggccatcttgccaccctgagggaaacgctgcctgagaatgaaacaagcataagtaaaagctgagctgtgagatggagcaagatgaaggccacatgacatctttggagcacctggatctaactgtgccttaagctagtctaaccctgaacatttcatcatttcattgacatgagcccaggttttctttttttttggatggagtcttgctctgtcgcccaggctggagtgcagtagctcaatctcggctcactgcaagctccacctcccgggttcacgccattctcctgccttagcctcccaagtagctgggacaacaggcgcccaccaccactcccagctaattttttgtatttttagtagagacggggttttaccatgttagccgggatggtcttgatctcctgacctcatgatccgcccgcctcggcctcccaaagtgctgggattacaggtgtgagccactgcacccagccctcaggttttccctttttttacccctccttttgaaaatttgatgtggaattttgccacctgcagccagaagagttttaactaatcagtgccataaattttatatagttctccttgcaaaatgtggatcagcctttctcagcaaatcctttgtcataaagtgctgaattgtaagtttgtcatgagaatcacatgagatcatgcatgtgaagaacctggcattatcctcctcatagaaaaaaaccagtaaatattaactacaggaagcaaggaaggagtggggtgaggggaagaagaaggggtactgatttaaaagaaccctggagtcctaaggataatctaggaaccctcagacccaatccgatacccctattctaaatgctcctagtgccctgtaccttcccctcataagccttcattatcattgtaatgatatgtttatgtaatattttgattaatgtctctccttcactgacctagcagttctagcagggcagtgattttgctgtgttgcatccccagcacctagtctggtatgtggcattcagcatatgtttattgaatgaatggccatgtggttattcagatcctccttgattattggggttaggattgtggcagaagtggcaaaatcagggagagtagtccctgtcccctctgtatcttatacactgcccacactcccaacacacatacacatacagagaattttgtctcaattagataattaacttctgcttggttgtaaaccaaaccactggttcttaaactttcattggatcattttattgaagaattaaatagtgtggttctggcctaatgtctggaaagccttgcagaggagtggattaggtctttgtgataacaggcagccttccctgctcctgtgtctttataaaatctatttaactggagtagtccaccctccctcaggctcttacaggaatatgttggaggctgtaggaaggtgggaaaccgagagggaaaggactgggccgctggagacttcactcattccctagcaagaaacaaaagcagtaaaaggtggcccgaggacaacctgaagctcactccttcagcacttttggctggaggtcacttgttggagccccactcagagctcagcacaccaccccaccagcagcctcctcctcccagctgaggctgcatttcatcccttcccccagcctgctttccctgagataggggagtgtttcccagggcccatgtgacttccactggcaagtgacgattaccaatggtttactagtcagtgaaactaccaaaggcttttgtgctgtagtaatccttttcctgtttaaaactctggggattttctaatgttgccaatagtttttcaagtcagcaattactgtgtggattatgtaatggctcggtattaaaaatagaaaagacaaaaaaaagcat

SEQ ID NO: 67150 - DNA, 2612 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccggtgaatcttattaatagtttaccacaattaagtgttcatttttagtctagaagggacaggcgtttattgtgcattggccagtgccagcacatccgatgcaaggcagttcaccgtattctatctttaatttttaccatggtcctctgaggtaggtgttcttatctctctctctctctctctcttttaaacaaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacaggttggttgaggggtttaacaaggctaagaaggtgagacgtggtcttgtaacacagtggttaagaatgtgactttggagccagcctgctaggggctgaattctgactcagccatttactaactgtgtgaccttaggctggagtgcaatggcatgatctcggctcatcacaacctctgcttcctgggttcaagcgattctcctgcctcagcctcccgagtacctgggactacaggcactcgccaccatgcccggctgatttttgtatttttaatagagatggtttcactatgttggccaggctggtctcgaactcctgaccttgtgatctgcccacctcagcctcgaaaagtgctgggattacaggcgtgagccactgcgcccagccttgtattttttttcagtttgggtagctgtccctaattcatttgttaaaggagaagcaagagcaagaacctttaatctgttctcctcttccctaatttgaaagtagcttgttattttgaatatcactttctctgaaatagcacatctccatctcagagaatggatttaatgtttggatacagccaaaagtcatttcattaccaaaccatggggtgaatataccatgtaaagcagtttgggatcagaactcacagtctgaattgtaagtgatgagactgctgtctctctgctacagcttcttggctggctctgaaggctctttgaaggcagatcctaacaaggggactgctttgaagggccattgttcatttggaatgataaagtctatgttgttcaaaaaacaaatgcttgtagcaggtattttttcactccagactgagaatattggtgggatattgataaggggtactgaatggtaataaacatgtgctctagctctgtgctagtcagcttatttcagaactctagtttgattcagtttcttgcctctgactcaaaatggagggagagtgatttgtttcatgacacccggaccgagctcgatctc

SEQ ID NO: 67151 - DNA, 2422 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccggtgaatcttattaatagtttaccacaattaagtgttcatttttagtctagaagggacaggcgtttattgtgcattggccagtgccagcacatccgatgcaaggcagttcaccgtattctatctttaatttttaccatggtcctctgaggtaggtgttcttatctctctctctctctctctcttttaaacaaggaagacaaacataaagatgaagtgcttaattcaaggtcacacaatgtcggggatggacctccagatttccttactgacctgcattatcttgtggatacctgagtgaattccacaccacccattttatagatgaaaccactgagacatggagcaattgactgagtagtcactgccccacccctgcctggagcctcacacatgactcgcctcctctcagtgaccacagatggagtcttgctgtgtcaccaggatggagtgcagtggcgcaatctcggctcactgcaacctctgcttcccgggttcaagtgattctcctgcctcagcaacccgagtagctggcactacaggaaaacaagctcagggctcccactgattgtacattatgagacggagtcttgctatgttgcccaggctggtcttgaactcctcacctcaagcgatcctcccgtcttggcctcccaagtgtcaggattacgggcatgtgctatcacacccaacctgatacattgcctttataaatttttttttctttattctaaaaaccagaaaaaacaaaactggatacatgtgcagaacatgcagaccaagtgtgttggggacttgagatgcgtacatgagtgtgatgtttcctgctgaaagcacaggtgagacgtggtcttgtaacacagtggttaagaatgtgactttggagccagcctgctaggggctgaattctgactcagccatttactaactgtgtgaccttagtctgtctagtgactggtgttgtcataagaagagagggacacagagggaagatggccacatgaagatggaggcagagattgcagttatgctgctgcaaactaaggaatggctctggccctccaaggattgctgataaccaccagaaactagaagagacaaggaaggattcttccctagagccttcagagggagcatggccctactgacacctggatttcaaacttgtagcttcctaaactgcaagagaataaatttctgttgttttaagccaaataaaaag

SEQ ID NO: 67152 - DNA, 1814 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgcttttcgggcccatgggcgcagccactgcgccaggctcaaggggggcggccccgtcagggcccgccatcttggaaggccttttttgccggttcttcccgctgaggaagtgtcgctcaagacgctggcctatgagttgtgatttctgccttttccccttcctccttgggctaagccagaccagaaagggccccgtgcgcaacgtgcttcacaatctctcagggaaagcggctaacgtggcgctactccgcctcccctgttccttacccttggggcggccgccatgtttcctgaacacaaaatggcgacacgtggttagcattcgtcgccaacgagaaattggggtcggcccgaaagctctagaatgcacccctcttcctccccggggccttccacctccgcgagttttatgacttaaaaaagcccacaggctggtctgaaggtcggaggcctaattttaacgcgttttcctccctttaatttgaaacgggaacgcgaatgactgtaaaatgtgggcacaatatttaatctctcgcctttttaaagcttaatagtggataataggggggcagtatcaagggataatttgggtccccacagtaccaaagcatttagaaacctctgtttaatttaaggaatgagataagttactgcttttctagacttcctagcatgggctgttgtgctggagagaacgagagctacgaagagactacagtgcctctgactttttcataggacagttggccggtgaatcttattaatagtttaccacaattaagtgttcatttttagtctagaagggacaggcgtttattgtgcattggccagtgccagcacatccgatgcaaggcagttcaccgtattctatctttaatttttaccatggtcctctgaggtaggtgttcttatctctctctctctctctctcttttaaacaaggaagacaaacataaagatgaagtgcttaattcaaggtcacacaatgtcggggatggacctccagatttccttactgaaaacaagctcagggctcccactgattgtacattatgagacggagtcttgctatgttgcccaggctggtcttgaactcctcacctcaagcgatcctcccgtcttggcctcccaagtgtcaggattacgggcatgtgctatcacacccaacctgatacattgcctttataaatttttttttctttattctaaaaaccagaaaaaacaaaactggatacatgtgcagaacatgcaggtttgttacatagctgtacgtgtgccatggtggtttgctgcacctattgacctatcctgtaagttccctcccctcacccccaccccccaacagccctgaagtgtcaacg

SEQ ID NO: 67153 - DNA, 711 bp, Homo sapiens
ttccgggggggaggggcggcgaggcgaggcctgcggagcgggtgcgcgcgggcgggcacgtggggccctttcgtccccggcgtccgggcgccctgcatggatcccccaccccagctcctgctccccggcggcggccggtgggcagaaagaccgaaacccactcacggccgcctgccgaatcgcggctctgctgtttgtggggcgtgctagaaacgtggtcctaaaaagaatggcgtccatttacataatgctttgtttgcgtttcgcaagtttctttcggttaaagccacagaaaccccacctcctgcccttgtgtcgtttccaccgcggcacccttttccgacattagaaacaatagtgtacgcctgtggaggcctcgtttgttcaggggctgccggccagggcttcaggacgtttctgcggctttccccgcgcggcctgggctcccgcggctgctctttagatgcatgcgagcagattcagattcagggtaaagtaggagggcaccgagagtgagccccatcatgtcaggcttgagcttccggttggtaaaggtgagtacacgtgtcagctaaagaggaagcccaatgaagggagataggaacccagtcactttggtctgtgcaagaagggacaagaaagatggacacgttcgccacttgtgtcctttctcgcagggaatttggttcaggaggggttacaaagcataaa

SEQ ID NO: 67154 - DNA, 436 bp, Homo sapiens
ctttttggttcttatactaagtttctccaagtttcatcattagtttaagtattttaatctgattttaactgccttactgattccccaagggtttgtttccccttttttcaactaagttaagaacttctagactatatacttaaaattgtagttaattgagatcggccacagttgaatttcttagctatgtaacaggattttcatttgaagctatttattcctgacaatctctactcttaaagtgtggagttctcttaaaggggctgtttttcagtgaaaatttccagatactcctcaaatgtgtttcaacattagccaggaatcaggaggaaatagagctcctgggatgctattatttcaaacccaggtagatgctccaagtttttcccagtggtctcagtaaaagtaggctgtctatctactaccgtgttgctcc

SEQ ID NO: 67155 - DNA, 3203 bp, Homo sapiens
agtgtgataaatgtagaaaagcctttattcatagatcatcgcttactaaacatgagaaaacacataaaggagagggagctttccctaatggaacagatcaaggaatttatcctggaaagaaacaccatgaatgtaccgactgtgggaaaacctttctctggaagacacagcttactgagcatcagagaattcacactggggagaaaccctttgaatgcaatgtatgtggaaaggccttcaggcatagctcatctcttggtcagcatgagaatgctcataccggagagaaaccctatcagtgtagtctctgtgggaaagccttccagcgcagctcctcccttgttcaacaccagcgaattcacactggagagaaaccctatcgatgtaatctatgtgggaggtcctttaggcatggcacatccctcactcaacacgaggtcacacacagtggagagaagcccttccagtgtaaggaatgtgggaaagcctttagtcgatgttcttcccttgtccaacatgagaggactcatactggagagaaaccttttgaatgtagcatatgtgggagggcttttggtcagagcccatccctttataaacatatgaggattcataagagaggcaaaccttaccaaagcagtaactacagcatagatttcaagcacagcacatctctcactcaagatgaaagcactcttaccgaagtgaaatcctaccattgtaatgactgtggggaagactttagtcacattacagactttactgaccatcagaggatccatactgcagagaacccctatgattgtgagcaggcttttagtcagcaagctatttctcatcctggagagaaaccctatcaatgtaatgtatgtgggaaagctttcaaaaggagtacaagtttcatagagcatcacagaattcatactggagagaaaccctatgaatgtaatgagtgtggagaagcctttagtcgacgctcatcgcttactcaacatgagagaacccacactggagagaaaccctatgaatgtattgactgtgggaaagcctttagtcaaagttcatctctcattcagcatgagagaactcatactggagagaagccctatgaatgtaatgaatgtgggagagccttccgaaaaaaaaccaacctgcatgatcatcagagaattcatactggagaaaaaccctattcttgtaaggaatgtgggaaaaacttcagccgaagttcagctcttactaaacaccagagaattcatactcgaaataaactctaggaaccgtgaaattaaggaatttgcagaatgctttagctaaaatgttctgattcaggatcagaggattcttagagagcttgggaatgtaatgaattacgtgtgtgtttatacgttgtgtgtggagaaaactgccagtagacagatttttttttttttttaacataaagacacattctcagatctgattacagactagtgtaaaaacagctacatgtatgtagctggttggggatgatatgcctgtatgttggactttgcttttgaatatatgtatgcaggatatcatcaagtttcaacatcttgacttgtgacccccaatgtcaacagcttttttaaaaaacaaattcctgcagtaatgaccaaaacccattttaaaaattgcttgacaactgcactcaactgcagctcttacattaacttcaccatggaaaccagttccaactccaggaagtcaccattcaaagaattagatcaactagcccaaccacttcattgtacagatgaagactgaaagccaaagatgtgaagtggtttccacagtatgatacagcctataagggtaaagctgggttaaaaatgcaggtttcctggatttggggccccatggccttgccagtgaaaaggttatttttggactcagagggctttaaaataaattttaagatgtatcagatacacaaacatttaatgggcacctatgggttggacactttgagaattcttaaaagtataagtgggagcaaaatgtatgcaaatttatcacaaactatttaaagcaacttcttggaggcttacaaaccacaatttaacagaaactgtagatggttgaactactagtgacttttttccccttttcccagttacaattatactttcagctaacatatgccagtttcacagaactattaagtccccttattgtactttttatggcatgcccatgaaaaagcactttcttaagcctacagtatcagatcaatgggaaaacaacagaaaactaagaggagaattttcccgttaattttcttgcagaaaagtataagtctaattgcccattgccataaattttgtcttgtactcagagaagcaacatgcactggctcattttatgtgcaaagaaaagatttcaccattaaaaaaattaacttggctaggtatggtgtctcacacctgtaatcccagcactttgggtggctaaggcagatagactgcttgaacccaggagttcaagaccagcctggacaacatggtgaaaccccatctctttaaaaaaaaaaaaaaatccaaaaattagctgggcatggtggcatgcagtggtagtcccagctactcaggaggctgaggtgggaggatcactggaacccgggagcagagactgcagtgagctgagatcacactactgcattccagcctgagcaacagagcaagacacacacacacatcaatttattttagttgtataatgcttttctattagtaaagcatcagctaagcttcagtggcctgctccatcccctaatgactcccatgggctatcctaaaggaacttccagaacctttgttggtgtgttgacattgaccatgcagaccaatttgggcacaactggacattgattccttttacacaagagctgcctcccaaagatagataaattttcccagccctaaatatgaatcatggggcaagatattggtcgtattgatggtgaacctttcctactggattctttgcatgccacatagcaggattcattgcctttctctcatcatggatggcatgcagcagcacccaagtattcttcattctttgcagggaaaaaattgtgcatgggggctgaaatgtaatatgtgtagctcaattagtctctcctctcagaagggcagatctgccattgaatattccattttgcatcacagaggtcgagc

SEQ ID NO: 67156 - DNA, 3874 bp, Homo sapiens
agtgtgataaatgtagaaaagcctttattcatagatcatcgcttactaaacatgagaaaacacataaaggagagggagctttccctaatggaacagatcaaggaatttatcctggaaagaaacaccatgaatgtaccgactgtgggaaaacctttctctggaagacacagcttactgagcatcagagaattcacactggggagaaaccctttgaatgcaatgtatgtggaaaggccttcaggcatagctcatctcttggtcagcatgagaatgctcataccggagagaaaccctatcagtgtagtctctgtgggaaagccttccagcgcagctcctcccttgttcaacaccagcgaattcacactggagagaaaccctatcgatgtaatctatgtgggaggtcctttaggcatggcacatccctcactcaacacgaggtcacacacagtggagagaagcccttccagtgtaaggaatgtgggaaagcctttagtcgatgttcttcccttgtccaacatgagaggactcatactggagagaaaccttttgaatgtagcatatgtgggagggcttttggtcagagcccatccctttataaacatatgaggattcataagagaggcaaaccttaccaaagcagtaactacagcatagatttcaagcacagcacatctctcactcaagatgaaagcactcttaccgaagtgaaatcctaccattgtaatgactgtggggaagactttagtcacattacagactttactgaccatcagaggatccatactgcagagaacccctatgattgtgagcaggcttttagtcagcaagctatttctcatcctggagagaaaccctatcaatgtaatgtatgtgggaaagctttcaaaaggagtacaagtttcatagagcatcacagaattcatactggagagaaaccctatgaatgtaatgagtgtggagaagcctttagtcgacgctcatcgcttactcaacatgagagaacccacactggagagaaaccctatgaatgtattgactgtgggaaagcctttagtcaaagttcatctctcattcagcatgagagaactcatactggagagaagccctatgaatgtaatgaatgtgggagagccttccgaaaaaaaaccaacctgcatgatcatcagagaattcatactggagaaaaaccctattcttgtaaggaatgtgggaaaaacttcagccgaagttcagctcttactaaacaccagagaattcatactcgaaataaactctaggaaccgtgaaattaaggaatttgcagaatgctttagctaaaatgttctgattcaggatcagaggattcttagagagcttgggaatgtaatgaattacgtgtgtgtttatacgttgtgtgtggagaaaactgccagtagacagatttttttttttttttaacataaagacacattctcagatctgattacagactagtgtaaaaacagctacatgtatgtagctggttggggatgatatgcctgtatgttggactttgcttttgaatatatgtatgcaggatatcatcaagtttcaacatcttgacttgtgacccccaatgtcaacagcttttttaaaaaacaaattcctgcagtaatgaccaaaacccattttaaaaattgcttgacaactgcactcaactgcagctcttacattaacttcaccatggaaaccagttccaactccaggaagtcaccattcaaagaattagatcaactagcccaaccacttcattgtacagatgaagactgaaagccaaagatgtgaagtggtttccacagtatgatacagcctataagggtaaagctgggttaaaaatgcaggtttcctggatttggggccccatggccttgccagtgaaaaggttatttttggactcagagggctttaaaataaattttaagatgtatcagatacacaaacatttaatgggcacctatgggttggacactttgagaattcttaaaagtataagtgggagcaaaatgtatgcaaatttatcacaaactatttaaagcaacttcttggaggcttacaaaccacaatttaacagaaactgtagatggttgaactactagtgacttttttccccttttcccagttacaattatactttcagctaacatatgccagtttcacagaactattaagtccccttattgtactttttatggcatgcccatgaaaaagcactttcttaagcctacagtatcagatcaatgggaaaacaacagaaaactaagaggagaattttcccgttaattttcttgcagaaaagtataagtctaattgcccattgccataaattttgtcttgtactcagagaagcaacatgcactggctcattttatgtgcaaagaaaagatttcaccattaaaaaaattaacttggctaggtatggtgtctcacacctgtaatcccagcactttgggtggctaaggcagatagactgcttgaacccaggagttcaagaccagcctggacaacatggtgaaaccccatctctttaaaaaaaaaaaaaaatccaaaaattagctgggcatggtggcatgcagtggtagtcccagctactcaggaggctgaggtgggaggatcactggaacccgggagcagagactgcagtgagctgagatcacactactgcattccagcctgagcaacagagcaagacacacacacacatcaatttattttagttgtataatgcttttctattagtaaagcatcagctaagcttcagtggcctgctccatcccctaatgactcccatgggctatcctaaaggaacttccagaacctttgttggtgtgttgacattgaccatgcagaccaatttgggcacaactggacattgattccttttacacaagagctgcctcccaaagatagataaattttcccagccctaaatatgaatcatggggcaagatattggtcgtattgatggtgaacctttcctactggattctttgcatgccacatagcaggattcattgcctttctctcatcatggatggcatgcagcagcacccaagtattcttcattctttgcagggaaaaaattgtgcatgggggctgaaatgtaatatgtgtagctcaattagtctctcctctgtgatgcaaaatggaatattcaatggcagatctgcccttctgagatgctgaccatccaaaacaccttgtttatggtgcaccatgattagctcacacacaatgccaaggctgtgcttctattatctgatacatagtttgacaatgggtaattctactcagaccctccctactgattggctaggatgcctgtcaggaactcattatgctactggttgtttggggatccccatagtggactactttcaggaatggcatgaattgtaaccaactgagtgctgcccccactgttacggaagtttataaaaccttagttccagaagacccaaaggagagtactggtttgtgtttggtgcttggcctagatccagccaccactctgaaactcatcacatcttcattgacagggagggagcccaggacatatgtgtggctcattgaccagaaggctttcttagtcccaacagccatgaaccatgcacttatggatacccagccttttagggctacgtgaaatgcatccttgtaacatcattgtattctttcaataaatagccttctgagttgaaaaaaaaaaaaaaaaaaaagtcgacgcggccgcgaatttagtagtattagtcaccccggaatttcgggcggggactctgggggtcaacatttccccaaggaggcggagttgagacttgcggaacagggcaaaaccgtttccgggtgaaatgtaaccgcc

SEQ ID NO: 67157 - DNA, 1248 bp, Homo sapiens
catacatgccttggcctgcgttatccataaaagcagctataccactatggcggtgctgttgacattgaccagtccataaccatctagtgccattcgtacatagatacctgtctatgacaagagctgcctcccaaagatagataaattttcccagccctaaatatgaatcatggggcaagatattggtcgtattgatggtgaacctttcctactggattctttgcatgccacatagcaggattcattgcctttctctcatcatggatggcatgcagcagcacccaagtattcttcattctttgcagggaaaaaattgtgcatgggggctgaaatgtaatatgtgtagctcaattagtctctcctctgtgatgcaaaatggaatattcaatggcagatctgcccttctgagatgctgaccatccaaaacaccttgtttatggtgcaccatgattagctcacacacaatgccaaggctgtgcttctattatctgatacatagtttgacaatgggtaattctactcagaccctccctactgattggctaggatgcctgtcaggaactcattatgctactggttgtttggggatccccatagtggactactttcaggaatggcatgaattgtaaccaactgagtgctgcccccactgttacggaagtttataaaaccttagttccagaagacccaaaggagagtactggtttgtgtttggtgcttggcctagatccagccaccactctgaaactcatcacatcttcattgacagggagggagcccaggacatatgtgtggctcattgaccagaaggctttcttagtcccaacagccatgaaccatgcacttatggatacccagccttttagggctacgtgaaatgcatccttgtaacatcattgtattctttcaataaatagccttctgagttgaatcctgagtctcaccaaaaaccaccacccgatatcaccacgcaacacacaaacctgttgtggcgcgccttgcggccgcctggaaaaagattttcttgaacaccaatctgcgtgtggggccgtcggcgccccccctgatgttgtgcgatcaacttcgcgcaatcgcggtcttcccacgaagaacacctgtcgcgacacagagtgtgtgtccgtcttcccccataaaaagacggcgccggcgacgcacgacggtttcggcaaacacaccagcgaggttccggcgctgtctggcgtctatccacgagggacacagcagcca

SEQ ID NO: 67158 - DNA, 4033 bp, Homo sapiens
agtgtgataaatgtagaaaagcctttattcatagatcatcgcttactaaacatgagaaaacacataaaggagagggagctttccctaatggaacagatcaaggaatttatcctggaaagaaacaccatgaatgtaccgactgtgggaaaacctttctctggaagacacagcttactgagcatcagagaattcacactggggagaaaccctttgaatgcaatgtatgtggaaaggccttcaggcatagctcatctcttggtcagcatgagaatgctcataccggagagaaaccctatcagtgtagtctctgtgggaaagccttccagcgcagctcctcccttgttcaacaccagcgaattcacactggagagaaaccctatcgatgtaatctatgtgggaggtcctttaggcatggcacatccctcactcaacacgaggtcacacacagtggagagaagcccttccagtgtaaggaatgtgggaaagcctttagtcgatgttcttcccttgtccaacatgagaggactcatactggagagaaaccttttgaatgtagcatatgtgggagggcttttggtcagagcccatccctttataaacatatgaggattcataagagaggcaaaccttaccaaagcagtaactacagcatagatttcaagcacagcacatctctcactcaagatgaaagcactcttaccgaagtgaaatcctaccattgtaatgactgtggggaagactttagtcacattacagactttactgaccatcagaggatccatactgcagagaacccctatgattgtgagcaggcttttagtcagcaagctatttctcatcctggagagaaaccctatcaatgtaatgtatgtgggaaagctttcaaaaggagtacaagtttcatagagcatcacagaattcatactggagagaaaccctatgaatgtaatgagtgtggagaagcctttagtcgacgctcatcgcttactcaacatgagagaacccacactggagagaaaccctatgaatgtattgactgtgggaaagcctttagtcaaagttcatctctcattcagcatgagagaactcatactggagagaagccctatgaatgtaatgaatgtgggagagccttccgaaaaaaaaccaacctgcatgatcatcagagaattcatactggagaaaaaccctattcttgtaaggaatgtgggaaaaacttcagccgaagttcagctcttactaaacaccagagaattcatactcgaaataaactctaggaaccgtgaaattaaggaatttgcagaatgctttagctaaaatgttctgattcaggatcagaggattcttagagagcttgggaatgtaatgaattacgtgtgtgtttatacgttgtgtgtggagaaaactgccagtagacagatttttttttttttttaacataaagacacattctcagatctgattacagactagtgtaaaaacagctacatgtatgtagctggttggggatgatatgcctgtatgttggactttgcttttgaatatatgtatgcaggatatcatcaagtttcaacatcttgacttgtgacccccaatgtcaacagcttttttaaaaaacaaattcctgcagtaatgaccaaaacccattttaaaaattgcttgacaactgcactcaactgcagctcttacattaacttcaccatggaaaccagttccaactccaggaagtcaccattcaaagaattagatcaactagcccaaccacttcattgtacagatgaagactgaaagccaaagatgtgaagtggtttccacagtatgatacagcctataagggtaaagctgggttaaaaatgcaggtttcctggatttggggccccatggccttgccagtgaaaaggttatttttggactcagagggctttaaaataaattttaagatgtatcagatacacaaacatttaatgggcacctatgggttggacactttgagaattcttaaaagtataagtgggagcaaaatgtatgcaaatttatcacaaactatttaaagcaacttcttggaggcttacaaaccacaatttaacagaaactgtagatggttgaactactagtgacttttttccccttttcccagttacaattatactttcagctaacatatgccagtttcacagaactattaagtccccttattgtactttttatggcatgcccatgaaaaagcactttcttaagcctacagtatcagatcaatgggaaaacaacagaaaactaagaggagaattttcccgttaattttcttgcagaaaagtataagtctaattgcccattgccataaattttgtcttgtactcagagaagcaacatgcactggctcattttatgtgcaaagaaaagatttcaccattaaaaaaattaacttggctaggtatggtgtctcacacctgtaatcccagcactttgggtggctaaggcagatagactgcttgaacccaggagttcaagaccagcctggacaacatggtgaaaccccatctctttaaaaaaaaaaaaaaatccaaaaattagctgggcatggtggcatgcagtggtagtcccagctactcaggaggctgaggtgggaggatcactggaacccgggagcagagactgcagtgagctgagatcacactactgcattccagcctgagcaacagagcaagacacacacacacatcaatttattttagttgtataatgcttttctattagtaaagcatcagctaagcttcagtggcctgctccatcccctaatgactcccatgggctatcctaaaggaacttccagaacctttgttggtgtgttgacattgaccatgcagaccaatttgggcacaactggacattgattccttttacacaagagctgcctcccaaagatagataaattttcccagccctaaatatgaatcatggggcaagatattggtcgtattgatggtgaacctttcctactggattctttgcatgccacatagcaggattcattgcctttctctcatcatggatggcatgcagcagcacccaagtattcttcattctttgcagggaaaaaattgtgcatgggggctgaaatgtaatatgtgtagctcaattagtctctcctctgtgatgcaaaatggaatattcaatggcagatctgcccttctgagatgctgaccatccaaaacaccttgtttatggtgcaccatgattagctcacacacaatgccaaggctgtgcttctattatctgatacatagtttgacaatgggtaattctactcagaccctccctactgattggctaggatgcctgtcaggaactcattatgctactggttgtttggggatccccatagtggactactttcaggaatggcatgaattgtaaccaactgagtgctgcccccactgttacggaagtttataaaaccttagttccagaagacccaaaggagagtactggtttgtgtttggtgcttggcctagatccagccaccactctgaaactcatcacatcttcattgacagggagggagcccaggacatatgtgtggctcattgaccagaaggctttcttagtcccaacagccatgaaccatgcacttatggatacccagccttttagggctacgtgaaatgcatccttgtaacatcattgtattctttcaataaatagccttctgagttgaatcctgagtctcaccaaaaaccaccacccgatatcaccacgcaacacacaaacctgttgtggcgcgccttgcggccgcctggaaaaagattttcttgaacaccaatctgcgtgtggggccgtcggcgccccccctgatgttgtgcgatcaacttcgcgcaatcgcggtcttcccacgaagaacacctgtcgcgacacagagtgtgtgtccgtcttcccccataaaaagacggcgccggcgacgcacgacggtttcggcaaacacaccagcgaggttccggcgctgtctggcgtctatccacgagggacacagcagcca

SEQ ID NO: 67159 - DNA, 4189 bp, Homo sapiens
gtgctcaggagctcaacttttacttcagctgttattaaccttcaaccacaagacaataacatctgttccttttatcccaattttacgtgcggcattcttagccatatctacactgtgtttttatgcacatcatcataccctgttgtagggctataaagaccctactatggtagaattgggagtggactgagggattaggacaaaaggatgtggaaaaccgcagatctagagatgcatagctattctcataacctaggaagagaggtggatttctccgtcatcaatagctgaacactccttgtgtttctaagtattgaatccataaagttacatgcaaacatacagcccttgccttcaggccaagccgtagttatgcagaaggcttgaagcaatcacagatttaacatttgtggttccagctattcaggaccaattcccaaactccacgacatgtaacaatttgtaattttgctaggacacagtttgatgcttaggttttaaggctggtgtgctagacgttatcaagtggtttgtgagagtagccctgtgtctccattgggtagagtagctgggtcgcaaggatcatgaagagatgaagaaatggctgtgaaaagccaactagcctcggtgatagtaagcaaaggtatagaaacactaaggaagttaccctttgtattgtcaaaggtttcagttttgtgtaaggtggtgattcacgggcagttaatctccatcactaaaattaaatccttttttattcattgcaaatagataatctgtggaagacattttggcttttctcgctagcagaaaatgtgaggcttcttcaggtttttcctgttcattgtttcacgggagcatcttccccaaaacactgcaaaactcaaagttctcaggctgatgtggcagaaagagcattgatctcggcttcaggagctaaattctctagtcctgactgtgccactaacagactgtgggacttcagacaagtacattcctttctcgggtttcttatgtcaaatggacagcgtgagaaggatcacaatgaaccagggatcagcttcacgattaaaacctaagacttaagagacggacatctgtccgttcctggctacacctccggcccatctggcccaccccaaactgcgcgaagcccctctccaccgacgccaggcctgtggcctcgcgcgaagctgttggtcgttaacatctcccccgcaatgggcgggatggagggcttcagcttccggctgcaaatggcgaggcggcgcgcggcgttgcccactggcctcggcatgggcctgcccacgcacccgcccagcgcgcgccggaccctgtctaccgccgttgaagggcttcccagccctagcagtgcgtactgggaagcccccaaaaggctctgcgaggccgaggagacccgttcggagtgggggaggggaagataaaccgaactatttatgttaatcagtgcatgcttcctttatggagattggccagggttttactctagtaaccaatcacttcagaacaagggcgggcccgttgatatctctcacactcattggttgagaggttgcggcgcaatggaaggtcttaaaccgagagtatccgggattatttttccccgccgtgcggtgcgtgtcccggaagtgacgcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttatcaaccaagagaaagaggtcaactaagatatgtggaacaaaaagcaggaattacttttaaacgtgtaggtgttccttctacaatggatttagttaaatctaaaagcatggatgccatcaggtctctggcttccgtttcttatgctgctgttgattttttccgaccatcagctcagagactgatagaagagaaaggtgcagtggatgcattggctgcagctttagcccacatttctggtgcatcaagctttgaaccacgatctttgatcacctctgataaggggtttgtgaccatgactctggaaagcctagaggaaatacaggatgtcagctgtgcttggaaagaacttaacagaaagctgagtagtaatgcagtgtctcagattaccagaatgtgcctcctgaaagggaatatgggtgtttgctttgatgttcctacaactgagtcagaaaggttacaggcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttca

SEQ ID NO: 67160 - DNA, 413 bp, Homo sapiens
ggcctcccaaagtgctgggatacaggcatgaactaccacgccggccatgtagctcttgtaaatgagactttctatcattaaattttaaaagaaatttattaggaggatcattttacaagggacatggaacaacatatagggtctacacaaactcttctagagaatactgtagattcttagcagtagttgtaaattcttattggatactgtgtttagttaccttttaaatttagaaaatacattaagcagccactgagtcatgcattattagtgaaacaaaaaaaatctacacatatgcatctaatttaaaatgtttggctttgttttgcttttagggtgtttgctttgatgttcctacaactgagtcagaaaggttacaggtatttttaaaattttatcttttaaatggttga

SEQ ID NO: 67161 - DNA, 4301 bp, Homo sapiens
gtgctcaggagctcaacttttacttcagctgttattaaccttcaaccacaagacaataacatctgttccttttatcccaattttacgtgcggcattcttagccatatctacactgtgtttttatgcacatcatcataccctgttgtagggctataaagaccctactatggtagaattgggagtggactgagggattaggacaaaaggatgtggaaaaccgcagatctagagatgcatagctattctcataacctaggaagagaggtggatttctccgtcatcaatagctgaacactccttgtgtttctaagtattgaatccataaagttacatgcaaacatacagcccttgccttcaggccaagccgtagttatgcagaaggcttgaagcaatcacagatttaacatttgtggttccagctattcaggaccaattcccaaactccacgacatgtaacaatttgtaattttgctaggacacagtttgatgcttaggttttaaggctggtgtgctagacgttatcaagtggtttgtgagagtagccctgtgtctccattgggtagagtagctgggtcgcaaggatcatgaagagatgaagaaatggctgtgaaaagccaactagcctcggtgatagtaagcaaaggtatagaaacactaaggaagttaccctttgtattgtcaaaggtttcagttttgtgtaaggtggtgattcacgggcagttaatctccatcactaaaattaaatccttttttattcattgcaaatagataatctgtggaagacattttggcttttctcgctagcagaaaatgtgaggcttcttcaggtttttcctgttcattgtttcacgggagcatcttccccaaaacactgcaaaactcaaagttctcaggctgatgtggcagaaagagcattgatctcggcttcaggagctaaattctctagtcctgactgtgccactaacagactgtgggacttcagacaagtacattcctttctcgggtttcttatgtcaaatggacagcgtgagaaggatcacaatgaaccagggatcagcttcacgattaaaacctaagacttaagagacggacatctgtccgttcctggctacacctccggcccatctggcccaccccaaactgcgcgaagcccctctccaccgacgccaggcctgtggcctcgcgcgaagctgttggtcgttaacatctcccccgcaatgggcgggatggagggcttcagcttccggctgcaaatggcgaggcggcgcgcggcgttgcccactggcctcggcatgggcctgcccacgcacccgcccagcgcgcgccggaccctgtctaccgccgttgaagggcttcccagccctagcagtgcgtactgggaagcccccaaaaggctctgcgaggccgaggagacccgttcggagtgggggaggggaagataaaccgaactatttatgttaatcagtgcatgcttcctttatggagattggccagggttttactctagtaaccaatcacttcagaacaagggcgggcccgttgatatctctcacactcattggttgagaggttgcggcgcaatggaaggtcttaaaccgagagtatccgggattatttttccccgccgtgcggtgcgtgtcccggaagtgacgcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagctttatggatatcgcaatttcggataagggattatggacctgtacttcccttatagggttgttatgaagatttaaacaagataagctgaaaacacattacacagtgctggagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttatcaaccaagagaaagaggtcaactaagatatgtggaacaaaaagcaggaattacttttaaacgtgtaggtgttccttctacaatggatttagttaaatctaaaagcatggatgccatcaggtctctggcttccgtttcttatgctgctgttgattttttccgaccatcagctcagagactgatagaagagaaaggtgcagtggatgcattggctgcagctttagcccacatttctggtgcatcaagctttgaaccacgatctttgatcacctctgataaggggtttgtgaccatgactctggaaagcctagaggaaatacaggatgtcagctgtgcttggaaagaacttaacagaaagctgagtagtaatgcagtgtctcagattaccagaatgtgcctcctgaaagggaatatgggtgtttgctttgatgttcctacaactgagtcagaaaggttacaggcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttca

SEQ ID NO: 67162 - DNA, 4243 bp, Homo sapiens
gtgctcaggagctcaacttttacttcagctgttattaaccttcaaccacaagacaataacatctgttccttttatcccaattttacgtgcggcattcttagccatatctacactgtgtttttatgcacatcatcataccctgttgtagggctataaagaccctactatggtagaattgggagtggactgagggattaggacaaaaggatgtggaaaaccgcagatctagagatgcatagctattctcataacctaggaagagaggtggatttctccgtcatcaatagctgaacactccttgtgtttctaagtattgaatccataaagttacatgcaaacatacagcccttgccttcaggccaagccgtagttatgcagaaggcttgaagcaatcacagatttaacatttgtggttccagctattcaggaccaattcccaaactccacgacatgtaacaatttgtaattttgctaggacacagtttgatgcttaggttttaaggctggtgtgctagacgttatcaagtggtttgtgagagtagccctgtgtctccattgggtagagtagctgggtcgcaaggatcatgaagagatgaagaaatggctgtgaaaagccaactagcctcggtgatagtaagcaaaggtatagaaacactaaggaagttaccctttgtattgtcaaaggtttcagttttgtgtaaggtggtgattcacgggcagttaatctccatcactaaaattaaatccttttttattcattgcaaatagataatctgtggaagacattttggcttttctcgctagcagaaaatgtgaggcttcttcaggtttttcctgttcattgtttcacgggagcatcttccccaaaacactgcaaaactcaaagttctcaggctgatgtggcagaaagagcattgatctcggcttcaggagctaaattctctagtcctgactgtgccactaacagactgtgggacttcagacaagtacattcctttctcgggtttcttatgtcaaatggacagcgtgagaaggatcacaatgaaccagggatcagcttcacgattaaaacctaagacttaagagacggacatctgtccgttcctggctacacctccggcccatctggcccaccccaaactgcgcgaagcccctctccaccgacgccaggcctgtggcctcgcgcgaagctgttggtcgttaacatctcccccgcaatgggcgggatggagggcttcagcttccggctgcaaatggcgaggcggcgcgcggcgttgcccactggcctcggcatgggcctgcccacgcacccgcccagcgcgcgccggaccctgtctaccgccgttgaagggcttcccagccctagcagtgcgtactgggaagcccccaaaaggctctgcgaggccgaggagacccgttcggagtgggggaggggaagataaaccgaactatttatgttaatcagtgcatgcttcctttatggagattggccagggttttactctagtaaccaatcacttcagaacaagggcgggcccgttgatatctctcacactcattggttgagaggttgcggcgcaatggaaggtcttaaaccgagagtatccgggattatttttccccgccgtgcggtgcgtgtcccggaagtgacgcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagggttgttatgaagatttaaacaagataagctgaaaacacattacacagtgctggagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttatcaaccaagagaaagaggtcaactaagatatgtggaacaaaaagcaggaattacttttaaacgtgtaggtgttccttctacaatggatttagttaaatctaaaagcatggatgccatcaggtctctggcttccgtttcttatgctgctgttgattttttccgaccatcagctcagagactgatagaagagaaaggtgcagtggatgcattggctgcagctttagcccacatttctggtgcatcaagctttgaaccacgatctttgatcacctctgataaggggtttgtgaccatgactctggaaagcctagaggaaatacaggatgtcagctgtgcttggaaagaacttaacagaaagctgagtagtaatgcagtgtctcagattaccagaatgtgcctcctgaaagggaatatgggtgtttgctttgatgttcctacaactgagtcagaaaggttacaggcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttca

SEQ ID NO: 67163 - DNA, 3928 bp, Homo sapiens
gtgctcaggagctcaacttttacttcagctgttattaaccttcaaccacaagacaataacatctgttccttttatcccaattttacgtgcggcattcttagccatatctacactgtgtttttatgcacatcatcataccctgttgtagggctataaagaccctactatggtagaattgggagtggactgagggattaggacaaaaggatgtggaaaaccgcagatctagagatgcatagctattctcataacctaggaagagaggtggatttctccgtcatcaatagctgaacactccttgtgtttctaagtattgaatccataaagttacatgcaaacatacagcccttgccttcaggccaagccgtagttatgcagaaggcttgaagcaatcacagatttaacatttgtggttccagctattcaggaccaattcccaaactccacgacatgtaacaatttgtaattttgctaggacacagtttgatgcttaggttttaaggctggtgtgctagacgttatcaagtggtttgtgagagtagccctgtgtctccattgggtagagtagctgggtcgcaaggatcatgaagagatgaagaaatggctgtgaaaagccaactagcctcggtgatagtaagcaaaggtatagaaacactaaggaagttaccctttgtattgtcaaaggtttcagttttgtgtaaggtggtgattcacgggcagttaatctccatcactaaaattaaatccttttttattcattgcaaatagataatctgtggaagacattttggcttttctcgctagcagaaaatgtgaggcttcttcaggtttttcctgttcattgtttcacgggagcatcttccccaaaacactgcaaaactcaaagttctcaggctgatgtggcagaaagagcattgatctcggcttcaggagctaaattctctagtcctgactgtgccactaacagactgtgggacttcagacaagtacattcctttctcgggtttcttatgtcaaatggacagcgtgagaaggatcacaatgaaccagggatcagcttcacgattaaaacctaagacttaagagacggacatctgtccgttcctggctacacctccggcccatctggcccaccccaaactgcgcgaagcccctctccaccgacgccaggcctgtggcctcgcgcgaagctgttggtcgttaacatctcccccgcaatgggcgggatggagggcttcagcttccggctgcaaatggcgaggcggcgcgcggcgttgcccactggcctcggcatgggcctgcccacgcacccgcccagcgcgcgccggaccctgtctaccgccgttgaagggcttcccagccctagcagtgcgtactgggaagcccccaaaaggctctgcgaggccgaggagacccgttcggagtgggggaggggaagataaaccgaactatttatgttaatcagtgcatgcttcctttatggagattggccagggttttactctagtaaccaatcacttcagaacaagggcgggcccgttgatatctctcacactcattggttgagaggttgcggcgcaatggaaggtcttaaaccgagagtatccgggattatttttccccgccgtgcggtgcgtgtcccggaagtgacgcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttatcaaccaagagaaagaggtcaactaagatatgtggaacaaaaagcaggaattacttttaaacgtgtaggtgttccttctacaatggatttagttaaatctaaaagcatggatgccatcaggtctctggcttccgtttcttatgctgctgttgattttttccgaccatcagctcagagactgatagaagagaaaggtgcagcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttca

SEQ ID NO: 67164 - DNA, 3630 bp, Homo sapiens
gtgctcaggagctcaacttttacttcagctgttattaaccttcaaccacaagacaataacatctgttccttttatcccaattttacgtgcggcattcttagccatatctacactgtgtttttatgcacatcatcataccctgttgtagggctataaagaccctactatggtagaattgggagtggactgagggattaggacaaaaggatgtggaaaaccgcagatctagagatgcatagctattctcataacctaggaagagaggtggatttctccgtcatcaatagctgaacactccttgtgtttctaagtattgaatccataaagttacatgcaaacatacagcccttgccttcaggccaagccgtagttatgcagaaggcttgaagcaatcacagatttaacatttgtggttccagctattcaggaccaattcccaaactccacgacatgtaacaatttgtaattttgctaggacacagtttgatgcttaggttttaaggctggtgtgctagacgttatcaagtggtttgtgagagtagccctgtgtctccattgggtagagtagctgggtcgcaaggatcatgaagagatgaagaaatggctgtgaaaagccaactagcctcggtgatagtaagcaaaggtatagaaacactaaggaagttaccctttgtattgtcaaaggtttcagttttgtgtaaggtggtgattcacgggcagttaatctccatcactaaaattaaatccttttttattcattgcaaatagataatctgtggaagacattttggcttttctcgctagcagaaaatgtgaggcttcttcaggtttttcctgttcattgtttcacgggagcatcttccccaaaacactgcaaaactcaaagttctcaggctgatgtggcagaaagagcattgatctcggcttcaggagctaaattctctagtcctgactgtgccactaacagactgtgggacttcagacaagtacattcctttctcgggtttcttatgtcaaatggacagcgtgagaaggatcacaatgaaccagggatcagcttcacgattaaaacctaagacttaagagacggacatctgtccgttcctggctacacctccggcccatctggcccaccccaaactgcgcgaagcccctctccaccgacgccaggcctgtggcctcgcgcgaagctgttggtcgttaacatctcccccgcaatgggcgggatggagggcttcagcttccggctgcaaatggcgaggcggcgcgcggcgttgcccactggcctcggcatgggcctgcccacgcacccgcccagcgcgcgccggaccctgtctaccgccgttgaagggcttcccagccctagcagtgcgtactgggaagcccccaaaaggctctgcgaggccgaggagacccgttcggagtgggggaggggaagataaaccgaactatttatgttaatcagtgcatgcttcctttatggagattggccagggttttactctagtaaccaatcacttcagaacaagggcgggcccgttgatatctctcacactcattggttgagaggttgcggcgcaatggaaggtcttaaaccgagagtatccgggattatttttccccgccgtgcggtgcgtgtcccggaagtgacgcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttatcaaccaagagaaagaggtcaactaagatatgtggaacaaaaagcaggaattacttttaaacgtgtaggtgttccttctacaatggatttagttaaatctaaaagcatggatgccatcaggtctctggcttccgtttcttatgctgctgttgattttttccgaccatcagctcagagactgatagaagagaaaggtgcagtggatgcattggctgcagctttagcccacatttctggtgcatcaagctttgaaccacgatctttgatcacctctgataagctgtagttccagatgcttgtggggctgaggtgagaagactgcttgagcccagaaggttgagggtgcagcgagccgagatcgtgccactgcactccaacctgggtgacagagcgagac

SEQ ID NO: 67165 - DNA, 585 bp, Homo sapiens
tcatctcccatattggaagaatgtgcctcctgaaagggaatatgggtgtttgctttgatgttcctacaactgagtcagaaaggttacaggcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttca

SEQ ID NO: 67166 - DNA, 533 bp, Homo sapiens
ttttgcatttatattaatcctgtaaattcccctaacagcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttca

SEQ ID NO: 67167 - DNA, 417 bp, Homo sapiens
tagctcacacttgttcactacaatatttactatgatcaattttggcggttttccactcatgtacaggtttttcccatttttcttcttatcttttattttttccctatgtcttgaccaagaatactatttttaaaccataggtctctggcttccgtttcttatgctgctgttgattttttccgaccatcagctcagagactgatagaagagaaaggtgcagtggatgcattggctgcagctttagcccacatttctggtgcatcaagctttgaaccacgatctttgatcacctctgataagctgtagttccagatgcttgtggggctgaggtgagaagactgcttgagcccagaaggttgagggtgcagcgagccgagatcgtgccactgcactccaacctgggtgacagagcgagac

SEQ ID NO: 67168 - DNA, 349 bp, Homo sapiens
aagacttccatttttctttaatgtaactctttcattttcagggaattacttttaaacgtgtaggtgttccttctacaatggatttagttaaatctaaaagcatggatgccatcaggtatgctttctgaacttgctgaataattgtttcttttgtattaggctattcatctgtaagctctcccagttcaaatagcagaaaattttaccaccagttttaccagcagacatttagttatattaaaatataaaacagtggctcatgcctgtaattccagcactttgggaggctgaggcgggcagctcatgaggtcaggagattgagaccatcctggctaacacggtgaaaccc

SEQ ID NO: 67169 - DNA, 444 bp, Homo sapiens
aaatattttaaaataattttaatgaaacaaataatgtggtattttctttcttcaaagcatttggccatccagtgtcattggtctcagaggccagcagttattggagatgtccttcaagtctacagtgggtctgaagggagggctattattttctgtgagaccaagaagaatgtaactgaaatggccatgaatccacacataaaacaggtaagtctttttttcatgctttctctaattgaaattatggggatgaatcactgaacgaaaattatattgtcctttgtggaccagatttgatagtcattctcaaaactgagttgtaaggctgggcatggtggcccacacctgtaatcctgtgacctgataagtcaggatagaattttatcagttttgtttgtttgtcttgagacagggtctccctcttatgcccaggctggagtgcag

SEQ ID NO: 67170 - DNA, 2565 bp, Homo sapiens
  misc_feature (2189)..(2189): n is a, c, g, or t
gtgctcaggagctcaacttttacttcagctgttattaaccttcaaccacaagacaataacatctgttccttttatcccaattttacgtgcggcattcttagccatatctacactgtgtttttatgcacatcatcataccctgttgtagggctataaagaccctactatggtagaattgggagtggactgagggattaggacaaaaggatgtggaaaaccgcagatctagagatgcatagctattctcataacctaggaagagaggtggatttctccgtcatcaatagctgaacactccttgtgtttctaagtattgaatccataaagttacatgcaaacatacagcccttgccttcaggccaagccgtagttatgcagaaggcttgaagcaatcacagatttaacatttgtggttccagctattcaggaccaattcccaaactccacgacatgtaacaatttgtaattttgctaggacacagtttgatgcttaggttttaaggctggtgtgctagacgttatcaagtggtttgtgagagtagccctgtgtctccattgggtagagtagctgggtcgcaaggatcatgaagagatgaagaaatggctgtgaaaagccaactagcctcggtgatagtaagcaaaggtatagaaacactaaggaagttaccctttgtattgtcaaaggtttcagttttgtgtaaggtggtgattcacgggcagttaatctccatcactaaaattaaatccttttttattcattgcaaatagataatctgtggaagacattttggcttttctcgctagcagaaaatgtgaggcttcttcaggtttttcctgttcattgtttcacgggagcatcttccccaaaacactgcaaaactcaaagttctcaggctgatgtggcagaaagagcattgatctcggcttcaggagctaaattctctagtcctgactgtgccactaacagactgtgggacttcagacaagtacattcctttctcgggtttcttatgtcaaatggacagcgtgagaaggatcacaatgaaccagggatcagcttcacgattaaaacctaagacttaagagacggacatctgtccgttcctggctacacctccggcccatctggcccaccccaaactgcgcgaagcccctctccaccgacgccaggcctgtggcctcgcgcgaagctgttggtcgttaacatctcccccgcaatgggcgggatggagggcttcagcttccggctgcaaatggcgaggcggcgcgcggcgttgcccactggcctcggcatgggcctgcccacgcacccgcccagcgcgcgccggaccctgtctaccgccgttgaagggcttcccagccctagcagtgcgtactgggaagcccccaaaaggctctgcgaggccgaggagacccgttcggagtgggggaggggaagataaaccgaactatttatgttaatcagtgcatgcttcctttatggagattggccagggttttactctagtaaccaatcacttcagaacaagggcgggcccgttgatatctctcacactcattggttgagaggttgcggcgcaatggaaggtcttaaaccgagagtatccgggattatttttccccgccgtgcggtgcgtgtcccggaagtgacgcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaaggtgcgctgagcatgggccgcgcctccttttgggctgcgccggcttgggcggggaggggaactgtctgtccctgatgatggcctgtcagaaccgggccggagcatccgagggcctcccttcgcgccgccctcggccctctggggtcgctcagggaccgtttccacctccaccctcccgacctggagaaagatggccctgggctttgggcctctcctccgcgtggcccctcagcccttcccgttggcgcctgaatctcagatgggcagactcaagctcccatcaccatggaatctgttctttctcttctgaagcagtgacgcttgccatttcgttttcattggccntcttagaagatgattaagaaaaaatgattgctttgaatatgtgttgcttctgtcaccccgtcccctgtgcaagaatcctggggaaagcgatcttaggtttacagacctcaataactagtctgtagaggcttaaggaaaagtgtcactgagacttgccaggatttgtcagtgatggagatcgtgtgggttgcattattaatagcctttactgtcagtattttcattcaatccgcaggtgtttattgaacctaatttgtaccatactctttgctgagtaccaaggaggttaaactaaataagtaaagaaatggtctctgctctcaaggagcctgtagaggagttgtagtctttcctcctcccagccccctgccctcca

SEQ ID NO: 67171 - DNA, 3907 bp, Homo sapiens
gtgctcaggagctcaacttttacttcagctgttattaaccttcaaccacaagacaataacatctgttccttttatcccaattttacgtgcggcattcttagccatatctacactgtgtttttatgcacatcatcataccctgttgtagggctataaagaccctactatggtagaattgggagtggactgagggattaggacaaaaggatgtggaaaaccgcagatctagagatgcatagctattctcataacctaggaagagaggtggatttctccgtcatcaatagctgaacactccttgtgtttctaagtattgaatccataaagttacatgcaaacatacagcccttgccttcaggccaagccgtagttatgcagaaggcttgaagcaatcacagatttaacatttgtggttccagctattcaggaccaattcccaaactccacgacatgtaacaatttgtaattttgctaggacacagtttgatgcttaggttttaaggctggtgtgctagacgttatcaagtggtttgtgagagtagccctgtgtctccattgggtagagtagctgggtcgcaaggatcatgaagagatgaagaaatggctgtgaaaagccaactagcctcggtgatagtaagcaaaggtatagaaacactaaggaagttaccctttgtattgtcaaaggtttcagttttgtgtaaggtggtgattcacgggcagttaatctccatcactaaaattaaatccttttttattcattgcaaatagataatctgtggaagacattttggcttttctcgctagcagaaaatgtgaggcttcttcaggtttttcctgttcattgtttcacgggagcatcttccccaaaacactgcaaaactcaaagttctcaggctgatgtggcagaaagagcattgatctcggcttcaggagctaaattctctagtcctgactgtgccactaacagactgtgggacttcagacaagtacattcctttctcgggtttcttatgtcaaatggacagcgtgagaaggatcacaatgaaccagggatcagcttcacgattaaaacctaagacttaagagacggacatctgtccgttcctggctacacctccggcccatctggcccaccccaaactgcgcgaagcccctctccaccgacgccaggcctgtggcctcgcgcgaagctgttggtcgttaacatctcccccgcaatgggcgggatggagggcttcagcttccggctgcaaatggcgaggcggcgcgcggcgttgcccactggcctcggcatgggcctgcccacgcacccgcccagcgcgcgccggaccctgtctaccgccgttgaagggcttcccagccctagcagtgcgtactgggaagcccccaaaaggctctgcgaggccgaggagacccgttcggagtgggggaggggaagataaaccgaactatttatgttaatcagtgcatgcttcctttatggagattggccagggttttactctagtaaccaatcacttcagaacaagggcgggcccgttgatatctctcacactcattggttgagaggttgcggcgcaatggaaggtcttaaaccgagagtatccgggattatttttccccgccgtgcggtgcgtgtcccggaagtgacgcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagggaattacttttaaacgtgtaggtgttccttctacaatggatttagttaaatctaaaagcatggatgccatcaggtctctggcttccgtttcttatgctgctgttgattttttccgaccatcagctcagagactgatagaagagaaaggtgcagtggatgcattggctgcagctttagcccacatttctggtgcatcaagctttgaaccacgatctttgatcacctctgataaggggtttgtgaccatgactctggaaagcctagaggaaatacaggatgtcagctgtgcttggaaagaacttaacagaaagctgagtagtaatgcagtgtctcagattaccagaatgtgcctcctgaaagggaatatgggtgtttgctttgatgttcctacaactgagtcagaaaggttacaggcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttca

SEQ ID NO: 67172 - DNA, 4147 bp, Homo sapiens
gtgctcaggagctcaacttttacttcagctgttattaaccttcaaccacaagacaataacatctgttccttttatcccaattttacgtgcggcattcttagccatatctacactgtgtttttatgcacatcatcataccctgttgtagggctataaagaccctactatggtagaattgggagtggactgagggattaggacaaaaggatgtggaaaaccgcagatctagagatgcatagctattctcataacctaggaagagaggtggatttctccgtcatcaatagctgaacactccttgtgtttctaagtattgaatccataaagttacatgcaaacatacagcccttgccttcaggccaagccgtagttatgcagaaggcttgaagcaatcacagatttaacatttgtggttccagctattcaggaccaattcccaaactccacgacatgtaacaatttgtaattttgctaggacacagtttgatgcttaggttttaaggctggtgtgctagacgttatcaagtggtttgtgagagtagccctgtgtctccattgggtagagtagctgggtcgcaaggatcatgaagagatgaagaaatggctgtgaaaagccaactagcctcggtgatagtaagcaaaggtatagaaacactaaggaagttaccctttgtattgtcaaaggtttcagttttgtgtaaggtggtgattcacgggcagttaatctccatcactaaaattaaatccttttttattcattgcaaatagataatctgtggaagacattttggcttttctcgctagcagaaaatgtgaggcttcttcaggtttttcctgttcattgtttcacgggagcatcttccccaaaacactgcaaaactcaaagttctcaggctgatgtggcagaaagagcattgatctcggcttcaggagctaaattctctagtcctgactgtgccactaacagactgtgggacttcagacaagtacattcctttctcgggtttcttatgtcaaatggacagcgtgagaaggatcacaatgaaccagggatcagcttcacgattaaaacctaagacttaagagacggacatctgtccgttcctggctacacctccggcccatctggcccaccccaaactgcgcgaagcccctctccaccgacgccaggcctgtggcctcgcgcgaagctgttggtcgttaacatctcccccgcaatgggcgggatggagggcttcagcttccggctgcaaatggcgaggcggcgcgcggcgttgcccactggcctcggcatgggcctgcccacgcacccgcccagcgcgcgccggaccctgtctaccgccgttgaagggcttcccagccctagcagtgcgtactgggaagcccccaaaaggctctgcgaggccgaggagacccgttcggagtgggggaggggaagataaaccgaactatttatgttaatcagtgcatgcttcctttatggagattggccagggttttactctagtaaccaatcacttcagaacaagggcgggcccgttgatatctctcacactcattggttgagaggttgcggcgcaatggaaggtcttaaaccgagagtatccgggattatttttccccgccgtgcggtgcgtgtcccggaagtgacgcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttatcaaccaagagaaagaggtcaactaagatatgtggaacaaaaagcaggaattacttttaaacgtgtaggtgttccttctacaatggatttagttaaatctaaaagcatggatgccatcaggtctctggcttccgtttcttatgctgctgttgattttttccgaccatcagctcagagactgatagaagagaaaggtgcagtggatgcattggctgcagctttagcccacatttctggtgcatcaagctttgaaccacgatctttgatcacctctgataaggggtttgtgaccatgactctggaaagcctagaggaaatacaggatgtcagctgtgcttggaaagaacttaacagaaagctgagtagtaatgcagtgtctcagattaccagaatgtgcctcctgaaagggaatatgggtgtttgctttgatgttcctacaactgagtcagaaaggttacaggcagagtggcatgattccgactggatactctcagtgccagccaaattacctgaaattgaagaatattatgatggaaacacatcttctaattccagacagaggagtggctggtcaagtggtcgatcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttca

SEQ ID NO: 67173 - DNA, 3271 bp, Homo sapiens
gtgctcaggagctcaacttttacttcagctgttattaaccttcaaccacaagacaataacatctgttccttttatcccaattttacgtgcggcattcttagccatatctacactgtgtttttatgcacatcatcataccctgttgtagggctataaagaccctactatggtagaattgggagtggactgagggattaggacaaaaggatgtggaaaaccgcagatctagagatgcatagctattctcataacctaggaagagaggtggatttctccgtcatcaatagctgaacactccttgtgtttctaagtattgaatccataaagttacatgcaaacatacagcccttgccttcaggccaagccgtagttatgcagaaggcttgaagcaatcacagatttaacatttgtggttccagctattcaggaccaattcccaaactccacgacatgtaacaatttgtaattttgctaggacacagtttgatgcttaggttttaaggctggtgtgctagacgttatcaagtggtttgtgagagtagccctgtgtctccattgggtagagtagctgggtcgcaaggatcatgaagagatgaagaaatggctgtgaaaagccaactagcctcggtgatagtaagcaaaggtatagaaacactaaggaagttaccctttgtattgtcaaaggtttcagttttgtgtaaggtggtgattcacgggcagttaatctccatcactaaaattaaatccttttttattcattgcaaatagataatctgtggaagacattttggcttttctcgctagcagaaaatgtgaggcttcttcaggtttttcctgttcattgtttcacgggagcatcttccccaaaacactgcaaaactcaaagttctcaggctgatgtggcagaaagagcattgatctcggcttcaggagctaaattctctagtcctgactgtgccactaacagactgtgggacttcagacaagtacattcctttctcgggtttcttatgtcaaatggacagcgtgagaaggatcacaatgaaccagggatcagcttcacgattaaaacctaagacttaagagacggacatctgtccgttcctggctacacctccggcccatctggcccaccccaaactgcgcgaagcccctctccaccgacgccaggcctgtggcctcgcgcgaagctgttggtcgttaacatctcccccgcaatgggcgggatggagggcttcagcttccggctgcaaatggcgaggcggcgcgcggcgttgcccactggcctcggcatgggcctgcccacgcacccgcccagcgcgcgccggaccctgtctaccgccgttgaagggcttcccagccctagcagtgcgtactgggaagcccccaaaaggctctgcgaggccgaggagacccgttcggagtgggggaggggaagataaaccgaactatttatgttaatcagtgcatgcttcctttatggagattggccagggttttactctagtaaccaatcacttcagaacaagggcgggcccgttgatatctctcacactcattggttgagaggttgcggcgcaatggaaggtcttaaaccgagagtatccgggattatttttccccgccgtgcggtgcgtgtcccggaagtgacgcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttactcactcagaggtgtcgcgggtcctctagaaccgcacg

SEQ ID NO: 67174 - DNA, 276 bp, Homo sapiens
tcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccatagaaacagttaac

SEQ ID NO: 67175 - DNA, 456 bp, Homo sapiens
tggaggaggccctgcagcaggccaaggaggacttggcgcggctgctgcgtgactaccaggagctgatgaacgtgaagctggccctagatgtggagatcgccacctaccgcaaactgctggagggcgaggagtgcaggatgtctggagacctcagcagcaatgtgactgtgtctgtgacaagcagcaccatttcatcaaatgtggcatccaaggctgcctttggaggttctggaggtagagggtccagttccggaggaggatacagctctggaagcagcagttatggctctggaggccgacagtctggctccagaggcggtagtggaggaggaggttctatctctggaggaggatatggctctggcggtggttctggaggaagatacggatctggtggtggctctaagggagggtccatctctggaggaggatatggctctggaggtggaaaacaca

SEQ ID NO: 67176 - DNA, 403 bp, Homo sapiens
atttgcgggtggaagtggtaaaacaacatgcatacagaacctaagtgttccaccacaacttgttttttctctctcccttacaggatgtctggagacctcagcagcaatgtgactgtgtctgtgacaagcagcaccatttcatcaaatgtggcatccaaggctgcctttggaggttctggaggtagagggtccagttccggaggaggatacagctctggaagcagcagttatggctctggaggccgacagtctggctccagaggcggtagtggaggaggaggttctatctctggaggaggatatggctctggcggtggttctggaggaagatacggatctggtggtggctctaagggagggtccatctctggaggaggatatggctctggaggtggaaaacaca

SEQ ID NO: 67177 - DNA, 470 bp, Homo sapiens
agcatcttgggtgacttaatctggctgaagcaattggaaggggaaaagctaccccaggccatcagcaagccagcatgacaaacagggagtggctttcttcaggaggttgctctgtccctgtctagaggcaatgcctcctatgcccagcttgatgtctggagacctcagcagcaatgtgactgtgtctgtgacaagcagcaccatttcatcaaatgtggcatccaaggctgcctttggaggttctggaggtagagggtccagttccggaggaggatacagctctggaagcagcagttatggctctggaggccgacagtctggctccagaggcggtagtggaggaggaggttctatctctggaggaggatatggctctggcggtggttctggaggaagatacggatctggtggtggctctaagggagggtccatctctggaggaggatatggctctggaggtggaaaacaca

SEQ ID NO: 67178 - DNA, 405 bp, Homo sapiens
gggtctgcaaagcatgccctgagcacccgttcacagccagctatgtgcaggatcctcacaccaaggagctggggtgggagttgagtcaatagccaggcctgcaccataggcgtgacccagacaggccatcacatggagatggaaaggcagcagataaggccacttcagagagacagggtggagcccatgtcctgctcctgagaccaagcaatgcctcttcatgcttccttgcagaccattccctcccactagtccagcccttggcaaccataggcttctttttttttttttttctcagacagggttttgctctgttgcccaggctggagtgcaatggcacaatcacagcttactacagcttattgcaatctccacttcccaggctcgagtgatcctccagcctca

SEQ ID NO: 67179 - DNA, 477 bp, Homo sapiens
aactaaagcaacagcagttaaaaaagacaaagaggaacattatataatggtagaaggactagtccaagaggaaaataccacaatcctaaatatatatacacctaagactggagctcctacatttataaaacaattactactagacctaagaaatgagatagacggcaacacaataatagtgggggactttagactgggcgtggtggctcaagcctgtaatctcagcactttgagaggccaaggcaggaggatcacttgaggtcaggagtttgagaccagcctggccaatatagtgaaacatcttctctactaaaaatacaaaaaattagccaggcgtggtggcgtgtgcctgtaatcccagctactggggagactgaggctggagaattttttgaacccagggggtggaggttgccatgagccaagattgtgcaactgtactccagcctggtgacagagtgagactctgtctcaaaa

SEQ ID NO: 67180 - DNA, 554 bp, Homo sapiens
gaaaagcaaccatagtggaaagataaaaaagatagaaaataagttatgaatgactacagacttctcaagatcaacagtggaggctgggagtcattgaaatactagcttcagagtgttaacagaaaattggagatgtagagcactgtatgcagctaaagtgtcattcaagagtcagggtgaaaaacatatatttacagaaatgactaaaatattttagcattgaaagaccctgtcttgaagaactactgaaggatatactccaggaagaaggaatttgaacccagaaagaaggaatacattgaaagaagtaataatgaacaacgaacaacaaaacattggtaaacatgagtaaatataaataaaccttgactatacatttaaaaaaaaaatgcctttctagcttgggaggacaaacaaacaaaatgtctagagcgggttattgtaattgaacagattttaatgcccttactttgtttaggtagaaaatatagtatccaagctagcagagatatgaagtggaattaggaaatttgatttattcaatagaaggcaag

SEQ ID NO: 67181 - DNA, 297 bp, Homo sapiens
cctgagaacaaacacaggtgcaaacaaaaccagggcgtttcagctggtaaatgctgccatgaggcagaacttgcttttccccaggctggaaattggagaacagtttgtcctggaccaagtgatgaaaggcagggcgacatgggggaagaattggaactcccagtcctatggctcagctgtaaattctgcagagtagagcagagaagggattgttttgttccctcttgggagaggacgtgatgctgagggcccagtgtgagaggctttgggcacagagcgacctttaatgattcccag

SEQ ID NO: 67182 - DNA, 430 bp, Homo sapiens
aaaatagttctccaaatagcttctgtgtaactcatatccagagtgagcatttatgtgtttgtaccacaagggtttctatacagtggaataaaaaggtgacccaagtaaatatatttaccagctatattataataataataattcaccaccaatcattacgcattgttctaaagtgtttaccaagtataaatcattttaattcttacaaaaaccctctgaggtactatcactactcccattttgtatctaaggaaactggggcaaaccgacatatgtaacttgctcagcatcccaagactgtgaatggtggagtctgggattgtagctatagcccgtgctacacgccacatttctatactgactgtgcatttctatacaggcagtgcatgaaccatttaaattcttaggaaacatgtttgtagatgcagtc

SEQ ID NO: 67183 - DNA, 675 bp, Homo sapiens
acggaaagaatagactaagatggtgtagtggccgtgctatataactacgctgtgcctgggaagagacttctagaattggaaatactgttttgtcctgttttagggtattgttgggtatagcagcttgaattgtggtggtgacaaataagaataaaagtagagagattaatatgtgggatcagaccaaggaatagttaggtattaataattcactattggttagatagtagtaggcttttaggtagagtgttttggttcaacagtttcagactgctttgtattaaacaagtttttattttggtatagtagactagtcatttccatttgtccactggtaaggtattaaactatactggatgggaaggagagcatctaatgtagtaggagcagtgttaatagtggcttggtggcatgaaatgagttggagtgttgagaaattgtcagctgtttttatggttagggagtttaatgtggtgtcagggcagctgggagaggtcagaggccaaataataaagggacttttttgtatacattacaaggaaattttttgtttttcgttttttttttttaaaacgtgaacagtggggaactgttgaagaggttagtcagtagaccaatatcacttttttcaacagtttatggtttccccttatttttaatgatttactcttattt

SEQ ID NO: 67184 - DNA, 641 bp, Homo sapiens
ttaggtatattattctcttgtcctttgtaggagttctagaattggaaatactgttttgtcctgttttagggtattgttgggtatagcagcttgaattgtggtggtgacaaataagaataaaagtagagagattaatatgtgggatcagaccaaggaatagttaggtattaataattcactattggttagatagtagtaggcttttaggtagagtgttttggttcaacagtttcagactgctttgtattaaacaagtttttattttggtatagtagactagtcatttccatttgtccactggtaaggtattaaactatactggatgggaaggagagcatctaatgtagtaggagcagtgttaatagtggcttggtggcatgaaatgagttggagtgttgagaaattgtcagctgtttttatggttagggagtttaatgtggtgtcagggcagctgggagaggtcagaggccaaataataaagggacttttttgtatacattacaaggaaattttttgtttttcgttttttttttttaaaacgtgaacagtggggaactgttgaagaggttagtcagtagaccaatatcacttttttcaacagtttatggtttccccttatttttaatgatttactcttattt

SEQ ID NO: 67185 - DNA, 3002 bp, Homo sapiens
  misc_feature (1)..(4): n is a, c, g, or t
  misc_feature (7)..(7): n is a, c, g, or t
  misc_feature (1132)..(1132): n is a, c, g, or t
  misc_feature (1506)..(1506): n is a, c, g, or t
  misc_feature (1670)..(1670): n is a, c, g, or t
nnnnagngacagatgcgtcctggcaacagtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgatttctcgaaaacgaagtgaatttggtgcaccaattaagttcagtgaccagaatgcttccagtgtaaaagatgcctatattgaatgtacagcctacccagataaaaattttacccttaaacaacttgaaaaagatgttggcatgcaagtaatcccccaaataaaggacataagcactcagacaaaatggacatatcctaaaaatgctactacgcaatattatccaagagaattctcagaagaggaaaaagagacactcaaacaatcaaagcctttggttgattttcttaacaatgcatccataagtgttgaaatagccctgcagcaaaatgaaatcatgaacacatttattgatgactggaaatacctcgcagaagaagaaggcacctttgggganaagaccgatacccacctgaaagagtaccagtcctttaccgaccttcatagcccaacggagaaaatgattacctgtgtctcatggcatccaactatctatgggctaatagctgtgtcggtagccgtgcgactttcttttgaagacagagttcacttttctggtaaattattgctgcagccatcactgattcttttctggagcttctctgatcctatacatcctcagttaatgctggagagcccagatgacatcttctgcttcaagttctgtccgagtgatcctaatatcattgctggaggctgtatcaatgggcagattgtcatgtgggatatcaccgcacatgcagatcgcatagaaaacattaaggcaggtgntagtagaagtaaaagagccacactgaagcctatgtttctccttgaaccggagagtaataaagaagcaatgtatatcagacactgtgcagtctcttcaatagaaaatggacataagaaagtaattacagatatacactggttgtctgacacatttgagattaacngaatgggctccgtctttgagaatcgaagtggaatatgctgtcaacttgtcacatgttcagcagattgcacaatatgtttttgggatattagaccacagaaacctttaaccccccaaacaacagagaaaaagaaggaggaaagtattgaaattccttttgatgtaccatctacttttttgcatctggatctctcctggaaacctctcactaaggtaaggctgtccaagggtgaaacaagtttagaccactgtccaaccaagataagcctgaatgaagaccatcttctttgcaaaacacaagacaaaatgttagcacagagcaaaacagagaaggcagaagaaatgaacccgtatcataatctggaaagtgggatggccaatcttctcaagccaatagatgacttctgcacaaagttctttgtgggaacagaggaaggcgaagtgatatacacagattggaaaatggaaaaagaccctgaaactggccgacttatgtcaaagaagccagtgagccaccacaccattcacgacggaactgtccacactattcagagatcacctttctacaacgacattattctcacggttggaggttggaacgtggccatatggaaagaaggtgttatgactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaaccactattttgaaagagaagtcaagcatctggaatacgtagaacagcgcaaaaaaattcgtgagcaagaaaagaaagaaatggaactagaaatggcaaagaaaaaagttaaaacatatcagaagtcaaaagaacaaatgcaggctgaattaaaaatggactatgagagttatctggaactggaaaagactgttcttatcaaccttggcctaatcaaagtcacagagaaggggtcatacatggaggtgatgtaaaaaagcttcctgaaggggtgttttggggacttcttccctctatttatttttatgtcaggtgaactggcatgctgaacatatatatatataggctcatttatagacttttatttccctgctattaaaacttttgaattttaaa

SEQ ID NO: 67186 - DNA, 594 bp, Homo sapiens
  misc_feature (1)..(4): n is a, c, g, or t
  misc_feature (7)..(7): n is a, c, g, or t
nnnnagngacagatgcgtcctggcaacagtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacttgggccggaaaggtggaggttgcagtgagccatgatcatgcccctgcactccagcctgggtgacagagtgagaccctgtctcaaaaagaaaaaaaaataaaataaaagctaacagtttataattaaaaatcatctttcatttagccttaacattttcaattttatttttatgattgttgttctgtttttaattttttattgtaatgaaatattttaaatgtttagaaaaaactacagagtagtataacaaatatctacacttaattatccagaattttaaaatattaatttttattatatttactttaaaacttttttaacaaaagaaataaatattacagacaatattccactccctctcgtatcctccctaattcc

SEQ ID NO: 67187 - DNA, 2796 bp, Homo sapiens
  misc_feature (1)..(4): n is a, c, g, or t
  misc_feature (7)..(7): n is a, c, g, or t
  misc_feature (1132)..(1132): n is a, c, g, or t
  misc_feature (1506)..(1506): n is a, c, g, or t
  misc_feature (1670)..(1670): n is a, c, g, or t
nnnnagngacagatgcgtcctggcaacagtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgatttctcgaaaacgaagtgaatttggtgcaccaattaagttcagtgaccagaatgcttccagtgtaaaagatgcctatattgaatgtacagcctacccagataaaaattttacccttaaacaacttgaaaaagatgttggcatgcaagtaatcccccaaataaaggacataagcactcagacaaaatggacatatcctaaaaatgctactacgcaatattatccaagagaattctcagaagaggaaaaagagacactcaaacaatcaaagcctttggttgattttcttaacaatgcatccataagtgttgaaatagccctgcagcaaaatgaaatcatgaacacatttattgatgactggaaatacctcgcagaagaagaaggcacctttgggganaagaccgatacccacctgaaagagtaccagtcctttaccgaccttcatagcccaacggagaaaatgattacctgtgtctcatggcatccaactatctatgggctaatagctgtgtcggtagccgtgcgactttcttttgaagacagagttcacttttctggtaaattattgctgcagccatcactgattcttttctggagcttctctgatcctatacatcctcagttaatgctggagagcccagatgacatcttctgcttcaagttctgtccgagtgatcctaatatcattgctggaggctgtatcaatgggcagattgtcatgtgggatatcaccgcacatgcagatcgcatagaaaacattaaggcaggtgntagtagaagtaaaagagccacactgaagcctatgtttctccttgaaccggagagtaataaagaagcaatgtatatcagacactgtgcagtctcttcaatagaaaatggacataagaaagtaattacagatatacactggttgtctgacacatttgagattaacngaatgggctccgtctttgagaatcgaagtggaatatgctgtcaacttgtcacatgttcagcagattgcacaatatgtttttgggatattagaccacagaaacctttaaccccccaaacaacagagaaaaagaaggaggaaagtattgaaattccttttgatgtaccatctacttttttgcatctggatctctcctggaaacctctcactaaggtaaggctgtccaagggtgaaacaagtttagaccactgtccaaccaagataagcctgaatgaagaccatcttctttgcaaaacacaagacaaaatgttagcacagagcaaaacagagaaggcagaagaaatgaacccgtatcataatctggaaagtgggatggccaatcttctcaagccaatagatgacttctgcacaaagttctttgtgggaacagaggaaggcgaagtgatatacacagattggaaaatggaaaaagaccctgaaactggccgacttatgtcaaagaagccagtgagccaccacaccattcacgacggaactgtccacactattcagagatcacctttctacaacgacattattctcacggttggaggttggaacgtggccatatggaaagaaggtgttatgactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaatccctcactctactgctcacttttgttctctgttttccagtcacacccttaactgattatttccagcctttacacatgctgattccttcaacctagaacgcttttcccctcattctaattactactcatcctacatgtcattttctcagaaaagctctcactgagcctccatcagaaggtccaggtatg

SEQ ID NO: 67188 - DNA, 2789 bp, Homo sapiens
  misc_feature (1)..(4): n is a, c, g, or t
  misc_feature (7)..(7): n is a, c, g, or t
  misc_feature (1132)..(1132): n is a, c, g, or t
  misc_feature (1506)..(1506): n is a, c, g, or t
  misc_feature (1670)..(1670): n is a, c, g, or t
nnnnagngacagatgcgtcctggcaacagtcggcagagttgctgcggtttgtgcccttgcgatttctttttctgagagaggagagtcaaactcccacctccagctctcgaaggagcttttcctgagggcactgcaaagaggctccttttctttcagatcagcagtatcagcccaagtcagaaccatggctccaaaacaaaagaaaaagacatcacgtggcaaaaaaagactaaaaccagtattagctgctagtgaagacatggaaccagtaaatatggagagcatgggtcatccagaaatttatcctttagtattaaccaccaagacccaagaaatatttaactgccgaatagatgaagatgtcacagatgaacaaccttataagcttatcaataaagaagacatttttgaggacctgcgcaacagagctgcagtatctgatttccacccagtcaaaaaaattgtccaggaatatcctggaaatgagcttctgcttgtttatgacaaagacttcaaatatggacttaacttttatcttattgcaactgaagagggcaaagaaaactatttaaatcccccagaagtaccagaagaacaagaagaatataaagaacatattcctgaagatgtgtatatttataaaccacctgtctctaaaccatgggtttctttgggcagtgaaaaagaaattgaggaagaatcagttacggaatctacaaagcagattacatatatgatttctcgaaaacgaagtgaatttggtgcaccaattaagttcagtgaccagaatgcttccagtgtaaaagatgcctatattgaatgtacagcctacccagataaaaattttacccttaaacaacttgaaaaagatgttggcatgcaagtaatcccccaaataaaggacataagcactcagacaaaatggacatatcctaaaaatgctactacgcaatattatccaagagaattctcagaagaggaaaaagagacactcaaacaatcaaagcctttggttgattttcttaacaatgcatccataagtgttgaaatagccctgcagcaaaatgaaatcatgaacacatttattgatgactggaaatacctcgcagaagaagaaggcacctttgggganaagaccgatacccacctgaaagagtaccagtcctttaccgaccttcatagcccaacggagaaaatgattacctgtgtctcatggcatccaactatctatgggctaatagctgtgtcggtagccgtgcgactttcttttgaagacagagttcacttttctggtaaattattgctgcagccatcactgattcttttctggagcttctctgatcctatacatcctcagttaatgctggagagcccagatgacatcttctgcttcaagttctgtccgagtgatcctaatatcattgctggaggctgtatcaatgggcagattgtcatgtgggatatcaccgcacatgcagatcgcatagaaaacattaaggcaggtgntagtagaagtaaaagagccacactgaagcctatgtttctccttgaaccggagagtaataaagaagcaatgtatatcagacactgtgcagtctcttcaatagaaaatggacataagaaagtaattacagatatacactggttgtctgacacatttgagattaacngaatgggctccgtctttgagaatcgaagtggaatatgctgtcaacttgtcacatgttcagcagattgcacaatatgtttttgggatattagaccacagaaacctttaaccccccaaacaacagagaaaaagaaggaggaaagtattgaaattccttttgatgtaccatctacttttttgcatctggatctctcctggaaacctctcactaaggtaaggctgtccaagggtgaaacaagtttagaccactgtccaaccaagataagcctgaatgaagaccatcttctttgcaaaacacaagacaaaatgttagcacagagcaaaacagagaaggcagaagaaatgaacccgtatcataatctggaaagtgggatggccaatcttctcaagccaatagatgacttctgcacaaagttctttgtgggaacagaggaaggcgaagtgatatacacagattggaaaatggaaaaagaccctgaaactggccgacttatgtcaaagaagccagtgagccaccacaccattcacgacggaactgtccacactattcagagatcacctttctacaacgacattattctcacggttggaggttggaacgtggccatatggaaagaaggtgttatgactggaccgctccttcagtcatgctgtgcaccaaaaaggtacacctcaggccactggtccctgactcggcccggagttttctacatcggccgagaagatggatacattgatatctgggaccttctggagaaaacccatgaaccagcccagtctcaaaacatttgcataactatgatcacctacatcaaaccctggatcttttcttctaaacagcaatttatagccacagctgattattatggaacactgcatatattagaaattccttggacattaagtcgcccttccaccaatgagatggcaagtgtcaaccactattttgaaagagaagtcaagcatctggaatacgtagaacagcgcaaaaaaattcgtgagcaagaaaagaaagaaatggaactagaaatggcaaagaaaaaagttgtaagttaaatttcagaaatgaaagatgttttcctcgaacaccagtggaaatatatttgtttggcttaatcca

SEQ ID NO: 67189 - DNA, 563 bp, Homo sapiens
  misc_feature (137)..(137): n is a, c, g, or t
  misc_feature (150)..(151): n is a, c, g, or t
  misc_feature (155)..(155): n is a, c, g, or t
  misc_feature (165)..(165): n is a, c, g, or t
  misc_feature (175)..(175): n is a, c, g, or t
  misc_feature (183)..(183): n is a, c, g, or t
  misc_feature (186)..(186): n is a, c, g, or t
  misc_feature (204)..(204): n is a, c, g, or t
  misc_feature (209)..(209): n is a, c, g, or t
  misc_feature (216)..(216): n is a, c, g, or t
tgccgaatccgtcgtgcaagacatgagagtcccgggttgaggaagggtacaagtctcttaagatccaacactcaaaagggccggttcttccaagggtgccgaattgtgggaagtggaccaaaatggctgatggcccnttaaaaacatcanntttnacaacgtcanggatttagcntaaaaagnatnggttaaaagctttggttnctagnaaaggtnagtgtgtgtggtttttttaagaagctgttttgctaaattatttttacttggaatgtttcaaacagatttcaggctgcaaacttgttttataatcgtttgcttctccaagtgaagctcagaaatacctaaaaatagctgtaacgttcgcgttaggaaagatggtgtttattccagtttgcatttttatggtgaaataaaatccttttccaatgaactaaaaaaaaaaaaaaagggcggccgctcgcgatctagaactagttttttttaatttacaaaaatataaaatatgaagacataaacccagttgccatctgcgtgacaataaaacattaatgctaacacttttt

SEQ ID NO: 67190 - DNA, 536 bp, Homo sapiens
gtaaaactcattttgtccacatgccaccaacaatggcagagaggtcccagaaagcttggttgttgaggacccatctaacaagtctcttgtcccatttccaaggcagtttcaaacacttaagcccaagtctgcaagagccaatttagaaacaatgttactcaagagaatttcagagtgcacttcctgccatgtacaatgaaggtagctacaatgaataacatgtttgatatttaatgttttcatcttctccattacccgccaggtacttagctcagaaatcaatccagagcaactagaatttttaaattatgatctctaaaaagagaaaaatttacaacacgaaagaacacttcgctttgctctaatattaaaaaatacaaagaaatgaaaactggagaccaggtgcggtgggtcacgcctgtaatccccaagttttgggaggtcaaggtggaaggataacttgagctcaggagattgaaaccagcctgggcaacatagttaagaatccatctctatttctataaatgtattttaaa

SEQ ID NO: 67191 - DNA, 558 bp, Homo sapiens
cccgggctcgcaggaattcggcacgaggtgacttagaccactttctttcaaggggactcagagagttatggaagcaaaacacgattttaatgtccccttggtaacaaggacttttgaacttagtatcctacatcatagatagttttcttttccttgaatttcctggattttttttctttctataatgttgttgattgttatcttaggtgccattttgcttttttcttttgtccaattgttctacatgtaaaaataacaattataaatgaacctgcttgtaactgctgggcagtcaggtttgtaacacctatggttttgaggaagcttgatttgatgactttaggcagtgtaaggataaatacagtagatttcaaaggacttttttatatccccacttctaaaacagtgtcatgaaaatgatgagcctgatgatgagttaatggaaatatttgggtttagaatctagagactatttcaacagctcagtggtttgttgccactagaaatttatgcatttgtcaatacctgtgaaaaaatacagaaaaaaaaagagaaaac

SEQ ID NO: 67192 - DNA, 612 bp, Homo sapiens
ctaagtggcctaaaataatgaataaactgctgaaagagtttgccctattcccaggaattatttcacacactgaaagaatctgtgacttagaccactttctttcaaggggactcagagagttatggaagcaaaacacgattttaatgtccccttggtaacaaggacttttgaacttagtatcctacatcatagatagttttcttttccttgaatttcctggattttttttctttctataatgttgttgattgttatcttaggtgccattttgcttttttcttttgtccaattgttctacatgtaaaaataacaattataaatgaacctgcttgtaactgctgggcagtcaggtttgtaacacctatggttttgaggaagcttgatttgatgactttaggcagtgtaaggataaatacagtagatttcaaaggacttttttatatccccacttctaaaacagtgtcatgaaaatgatgagcctgatgatgagttaatggaaatatttgggtttagaatctagagactatttcaacagctcagtggtttgttgccactagaaatttatgcatttgtcaatacctgtgaaaaaatacagaaaaaaaaagagaaaac

SEQ ID NO: 67193 - DNA, 451 bp, Homo sapiens
ctgggacaattcagtatggcaaaggtgaccagtgagccacagaagcctaatgaagatgtggacgaacagaccccatcaacctcaagtaccaaagggaggaagaaggggaagacaccccgtcaacgaaggtccagaagcggcgttaagggcctaaagaccaccaggaaggcgaaaagaccccttcgagggagctcgagccaaaaagccggtgaaactaacacccctgcaggaaaacctaagaaagctagaggaccaatactgcgtggtcgttatcaccggctgaaagaaaaaatgaagaaagaagaggccgacaaagagcaaagcgagacctcagttctgtgatgtctctagaggtccgccactgaaaagtcatcaatcatacagtcagtgaattctacaccaacaggttaaaaccatgaaaataaaatcaacctgaatcgaaaaaatatgt

SEQ ID NO: 67194 - DNA, 251 bp, Homo sapiens
gagttgcggggttgagggcaactctccagcatggcttactgacctgggaaggaagtctgcttttctgtgggcaaagcagactccagagactgtgaggaaaacttcacctgattcatagctgaagaggctataattccttttgttaatatccagcaatatgttttggtcttgaacatgtgaggcttcacatgtgcatgtgtgtgcatattcatacatggaaaatgtatggggagaaacaaatgtggaggcag

SEQ ID NO: 67195 - DNA, 279 bp, Homo sapiens
tacttgtcagtttgcctctcagacttaataccaggagggaataaaaatcatcattactctctagctgctcaatggcatacatgaaatgaataggaggcttaactctggtctaactggctcagtttctgcttgtatcagcagagagccagagactgaatgatccagcttcctgtccattatcccatcaagtccaaaccaggtagggatgcccagacacatgtattccatagggaaagaagaacaccaaagaggagaacaaaagaagtctcggaaaaggga

SEQ ID NO: 67196 - DNA, 451 bp, Homo sapiens
gcctactactactactaaatttgcggcggtcgacttttgtttttgtttttgtattgtttatcctgtgtttttgtttttgattacaaatttaactttgcccttgttggatctgtgatttatcatgcattcttacagtatgtttgaagtttttaaactattatcaacaatgaagactgttaaaaaaaaattagttgccaggcacggtggctcaagcctgtattcctagcactttgggaggctgaggcgggccgatcacctgagatcgggagttcgagaccagcctgaccaacatggagaaaccctgtctctactaaaaatacaaaattagccaagcgtggtggcacatacctgtaatcgcagctactcaggaggctgaggcaggagaatcacttgaacctgagagaccagaggtttcagtgagctgagatcgcacccttgcactccatcctgg

SEQ ID NO: 67197 - DNA, 647 bp, Homo sapiens
ggggggcgtttaaaaatacttctgggataaaatatatttttctaagtaatttccaagcgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcaaaaaccat

SEQ ID NO: 67198 - DNA, 4052 bp, Homo sapiens
cgggggcctggccgcgcgctcccctcccgcaggcgccacctcggacatccccgggattgctacttctctgccaacttcgccaactcgccagcacttggagaggcccggctcccctcccggcgccctctgaccgcccccgccccgcggcgctctccgaccaccgcctctcggatgaccaggttccaggggagctgagcgagtcgcctcccccgcccagcttcagccctggctgcagctgcagcgcgagccatgcgcccccagtgcaccccggcccaccgccccggggccattctgctgaccgcccagccccgagccccgacagtggcaagttgcggctactgcagttgcaagctccggccaacccggaggagccccacggggaaggcagtcgtgcgccccccgcccccgggcgccccgcagcagccgggcgttcactcatcctccctcccccaccgtccctcccttttctcctcaagtcctgaagttgagtttgagaggcgacacggcggcggcgccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacataccccgttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaagttccccttattattatagtgccgccccccggtccgcccctgccgctcgtgccgctgcctatgaccgccactagttaccgcggggaccacatcaagcttcaggccgacagcttcggcctccacatcgtccccgtctgaccccaccccggaggagggaggaccgacgcgacgcatgcctcccggccaccgccccagcctcaccccatcccacgacccccgcaacccttcacatcacccccctcgaaggtcggacaggacgggtggagccgcggggcgggaccctcaggcccgggcccaccgcccccagccccgcctgccgcccctccccgcctgcctggactgcgcggcgccgtgagggggattcggcccagctcgtcccggcctccaccaagccagccccgaagcccgccagccaccctgccgtactcgggcgcgacctgctggtgcgcgccggatgtttctgtgacacacaatcagcgcggaccgcagcgcggcccagccccgggcacccgcctcggacgctcgggcgccaggagcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaagaaagaaatctcatatgcaaaatgagcgaacatggtctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcaaaaaccat

SEQ ID NO: 67199 - DNA, 4135 bp, Homo sapiens
cgggggcctggccgcgcgctcccctcccgcaggcgccacctcggacatccccgggattgctacttctctgccaacttcgccaactcgccagcacttggagaggcccggctcccctcccggcgccctctgaccgcccccgccccgcggcgctctccgaccaccgcctctcggatgaccaggttccaggggagctgagcgagtcgcctcccccgcccagcttcagccctggctgcagctgcagcgcgagccatgcgcccccagtgcaccccggcccaccgccccggggccattctgctgaccgcccagccccgagccccgacagtggcaagttgcggctactgcagttgcaagctccggccaacccggaggagccccacggggaaggcagtcgtgcgccccccgcccccgggcgccccgcagcagccgggcgttcactcatcctccctcccccaccgtccctcccttttctcctcaagtcctgaagttgagtttgagaggcgacacggcggcggcgccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacataccccgttgtgactggtcgtgacatggcgagcaccactctgcctggttacccccctcacgtgccccccactggccagggaagctaccccacctccaccctggcaggaatggtgcctgaggctgcagttggtccctcatcctccctcatgagcaagccggggaggaagcttgcagaagtgcccccttgtgtgcaacccactggagcgagttctccggcaacccgtacagccacccccagtacacggcctacaacgaggcttggagattcagcaaccccgccttactaagttccccttattattatagtgccgccccccggtccgcccctgccgctcgtgccgctgcctatgaccgccactagttaccgcggggaccacatcaagcttcaggccgacagcttcggcctccacatcgtccccgtctgaccccaccccggaggagggaggaccgacgcgacgcatgcctcccggccaccgccccagcctcaccccatcccacgacccccgcaacccttcacatcacccccctcgaaggtcggacaggacgggtggagccgcggggcgggaccctcaggcccgggcccaccgcccccagccccgcctgccgcccctccccgcctgcctggactgcgcggcgccgtgagggggattcggcccagctcgtcccggcctccaccaagccagccccgaagcccgccagccaccctgccgtactcgggcgcgacctgctggtgcgcgccggatgtttctgtgacacacaatcagcgcggaccgcagcgcggcccagccccgggcacccgcctcggacgctcgggcgccaggagcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaagaaagaaatctcatatgcaaaatgagcgaacatggtctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcaaaaaccat

SEQ ID NO: 67200 - DNA, 4121 bp, Homo sapiens
cgggggcctggccgcgcgctcccctcccgcaggcgccacctcggacatccccgggattgctacttctctgccaacttcgccaactcgccagcacttggagaggcccggctcccctcccggcgccctctgaccgcccccgccccgcggcgctctccgaccaccgcctctcggatgaccaggttccaggggagctgagcgagtcgcctcccccgcccagcttcagccctggctgcagctgcagcgcgagccatgcgcccccagtgcaccccggcccaccgccccggggccattctgctgaccgcccagccccgagccccgacagtggcaagttgcggctactgcagttgcaagctccggccaacccggaggagccccacggggaaggcagtcgtgcgccccccgcccccgggcgccccgcagcagccgggcgttcactcatcctccctcccccaccgtccctcccttttctcctcaagtcctgaagttgagtttgagaggcgacacggcggcggcgccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagttgaggtatacactgatcctgcccacattagaggaggtggaggtttgcatctggtctggactttaagagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacataccccgttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaagttccccttattattatagtgccgccccccggtccgcccctgccgctcgtgccgctgcctatgaccgccactagttaccgcggggaccacatcaagcttcaggccgacagcttcggcctccacatcgtccccgtctgaccccaccccggaggagggaggaccgacgcgacgcatgcctcccggccaccgccccagcctcaccccatcccacgacccccgcaacccttcacatcacccccctcgaaggtcggacaggacgggtggagccgcggggcgggaccctcaggcccgggcccaccgcccccagccccgcctgccgcccctccccgcctgcctggactgcgcggcgccgtgagggggattcggcccagctcgtcccggcctccaccaagccagccccgaagcccgccagccaccctgccgtactcgggcgcgacctgctggtgcgcgccggatgtttctgtgacacacaatcagcgcggaccgcagcgcggcccagccccgggcacccgcctcggacgctcgggcgccaggagcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaagaaagaaatctcatatgcaaaatgagcgaacatggtctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcaaaaaccat

SEQ ID NO: 67201 - DNA, 3001 bp, Homo sapiens
cgggggcctggccgcgcgctcccctcccgcaggcgccacctcggacatccccgggattgctacttctctgccaacttcgccaactcgccagcacttggagaggcccggctcccctcccggcgccctctgaccgcccccgccccgcggcgctctccgaccaccgcctctcggatgaccaggttccaggggagctgagcgagtcgcctcccccgcccagcttcagccctggctgcagctgcagcgcgagccatgcgcccccagtgcaccccggcccaccgccccggggccattctgctgaccgcccagccccgagccccgacagtggcaagttgcggctactgcagttgcaagctccggccaacccggaggagccccacggggaaggcagtcgtgcgccccccgcccccgggcgccccgcagcagccgggcgttcactcatcctccctcccccaccgtccctcccttttctcctcaagtcctgaagttgagtttgagaggcgacacggcggcggcgccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacataccccgttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaagttccccttattattatagtgccgccccccggtccgcccctgccgctcgtgccgctgcctatgaccgccactagttaccgcggggaccacatcaagcttcaggccgacagcttcggcctccacatcgtccccgtctgaccccaccccggaggagggaggaccgacgcgacgcatgcctcccggccaccgccccagcctcaccccatcccacgacccccgcaacccttcacatcacccccctcgaaggtcggacaggacgggtggagccgcggggcgggaccctcaggcccgggcccaccgcccccagccccgcctgccgcccctccccgcctgcctggactgcgcggcgccgtgagggggattcggcccagctcgtcccggcctccaccaagccagccccgaagcccgccagccaccctgccgtactcgggcgcgacctgctggtgcgcgccggatgtttctgtgacacacaatcagcgcggaccgcagcgcggcccagccccgggcacccgcctcggacgctcgggcgccaggagcttcgctggaggggctgggccaaggagattaagaagaaaacgactttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcaaaaaccat

SEQ ID NO: 67202 - DNA, 4033 bp, Homo sapiens
cgggggcctggccgcgcgctcccctcccgcaggcgccacctcggacatccccgggattgctacttctctgccaacttcgccaactcgccagcacttggagaggcccggctcccctcccggcgccctctgaccgcccccgccccgcggcgctctccgaccaccgcctctcggatgaccaggttccaggggagctgagcgagtcgcctcccccgcccagcttcagccctggctgcagctgcagcgcgagccatgcgcccccagtgcaccccggcccaccgccccggggccattctgctgaccgcccagccccgagccccgacagtggcaagttgcggctactgcagttgcaagctccggccaacccggaggagccccacggggaaggcagtcgtgcgccccccgcccccgggcgccccgcagcagccgggcgttcactcatcctccctcccccaccgtccctcccttttctcctcaagtcctgaagttgagtttgagaggcgacacggcggcggcgccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacataccccgttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaatgccgccccccggtccgcccctgccgctcgtgccgctgcctatgaccgccactagttaccgcggggaccacatcaagcttcaggccgacagcttcggcctccacatcgtccccgtctgaccccaccccggaggagggaggaccgacgcgacgcatgcctcccggccaccgccccagcctcaccccatcccacgacccccgcaacccttcacatcacccccctcgaaggtcggacaggacgggtggagccgcggggcgggaccctcaggcccgggcccaccgcccccagccccgcctgccgcccctccccgcctgcctggactgcgcggcgccgtgagggggattcggcccagctcgtcccggcctccaccaagccagccccgaagcccgccagccaccctgccgtactcgggcgcgacctgctggtgcgcgccggatgtttctgtgacacacaatcagcgcggaccgcagcgcggcccagccccgggcacccgcctcggacgctcgggcgccaggagcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaagaaagaaatctcatatgcaaaatgagcgaacatggtctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcaaaaaccat

SEQ ID NO: 67203 - DNA, 4102 bp, Homo sapiens
cgggggcctggccgcgcgctcccctcccgcaggcgccacctcggacatccccgggattgctacttctctgccaacttcgccaactcgccagcacttggagaggcccggctcccctcccggcgccctctgaccgcccccgccccgcggcgctctccgaccaccgcctctcggatgaccaggttccaggggagctgagcgagtcgcctcccccgcccagcttcagccctggctgcagctgcagcgcgagccatgcgcccccagtgcaccccggcccaccgccccggggccattctgctgaccgcccagccccgagccccgacagtggcaagttgcggctactgcagttgcaagctccggccaacccggaggagccccacggggaaggcagtcgtgcgccccccgcccccgggcgccccgcagcagccgggcgttcactcatcctccctcccccaccgtccctcccttttctcctcaagtcctgaagttgagtttgagaggcgacacggcggcggcgccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagttgaggtatacactgatcctgcccacattagaggaggtggaggtttgcatctggtctggactttaagagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacataccccgttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaatgccgccccccggtccgcccctgccgctcgtgccgctgcctatgaccgccactagttaccgcggggaccacatcaagcttcaggccgacagcttcggcctccacatcgtccccgtctgaccccaccccggaggagggaggaccgacgcgacgcatgcctcccggccaccgccccagcctcaccccatcccacgacccccgcaacccttcacatcacccccctcgaaggtcggacaggacgggtggagccgcggggcgggaccctcaggcccgggcccaccgcccccagccccgcctgccgcccctccccgcctgcctggactgcgcggcgccgtgagggggattcggcccagctcgtcccggcctccaccaagccagccccgaagcccgccagccaccctgccgtactcgggcgcgacctgctggtgcgcgccggatgtttctgtgacacacaatcagcgcggaccgcagcgcggcccagccccgggcacccgcctcggacgctcgggcgccaggagcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaagaaagaaatctcatatgcaaaatgagcgaacatggtctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcaaaaaccat

SEQ ID NO: 67204 - DNA, 271 bp, Homo sapiens
gtaagaagtaaaaataactccaaagaatacaaaaataatagatatgagaacagcccctacctctagggttgccacagagtgcccaaggaagaggcccggcagggttgagatccacaccttgatggagagggtgtggcgatggctccctggatggcaacgtctctgtaatgccatgttggcagaacttgctggaaatccaccctctggaatttactggaaatccatctttttgggtcccaaggaaagttgtttgtgggaggtatcttgctgg

SEQ ID NO: 67205 - DNA, 335 bp, Homo sapiens
aaggtgcatggtggagagaccatgagactcactgtccaggagaagaatgtcccagggtcaactgatcagttagggtagggcaggaaccagtcatagtggtggaaggtcatatggagggtcaatcggtgaaggcaggaactggggtttcacttcttctgtggtttttcggctgctccagatttcgtggctcctgcagaccatctggacatatgtgtgcaggtcacaggggttataatggctgagctttggctcagaggcctgacagaactcacacacacacacacacacacacacacacaccatattcatacacatgtgggcaagtgtatgtatgc

SEQ ID NO: 67206 - DNA, 465 bp, Homo sapiens
tgcatatatttcagaatcatgggttgtacaaaatgaagtatattgtaaaaggcttatgtattatgtattatgtattaagtaggaaatattaaggttaatcaagtaaagatgaattcatccagcctaacctttccatccatgccaaatctgaagctttggactcataactgagtttgactgctgcagatcccaccatacttactaagtaggtataagggatccattttaatacatttcaatggttatatttagtaatacattttattcacttgcatttgtacaaaagaacttttttttaacaaaatgaagaattgtgtggaataaaaaattgagtttcttttgtttgaaattattaatgtttgaaatagattcatattgtataaaaatggaaatatatttgcattaatatttagcatgtcatttttgatccctggacaataaataatgactggtttgatgataaca

SEQ ID NO: 67207 - DNA, 899 bp, Homo sapiens
agacagggtcttgctctgttgcctgggctggtcttgaactcctgtccttaagagattctcccaaagtagcctcccacagtgttaggattacaggtgtgagccaccatgcccagcctgtttcttaacttgtatatttgacagaaattttcttgaacaccaggaactaaaaccaagaaacaacaaacaagaaaactcctggtcttgaaattgtctctgtgttggggctctcctttgatgcttagccaaacttgaactaaggtttgagatcagctcaaggttaaagtttaaggttttctctggtcttttattttgtaatagtgttttcattttcattcaacttcttttcttatttcccctctcagatcttttctgatcgtgtatctcatcctaggcatacatgtgtctttctgaattctccctattcacgggtgcttttgaatgcactaatttcctaaagacactctctgttttttttttctcccatatcttaggtggtttcaacagtaatcttttgcccagacatctgcaggttgttcctctaccttaccatgatttaaagaaatgcctgctacatttccagcctggataagttctgagttaggtgaaacagagatgtgttccttgtgtcagtccttcaggcagcccacagacaggttagagcagacatatgcggaaatttgtgaatgaggtctgctctgcttcctccagaaccagggaggaaatgggacaagtgtaattaaaaaggcacagagctttcataccattttcttttatttttttgagacagagtctcactctgtcacctagtctggagtgcagtgagctgagatggcgccattgcactccagcctgggtgacaagaagcagaactccatctcagaaacaaaacaaaacatctc

SEQ ID NO: 67208 - DNA, 924 bp, Homo sapiens
cctggctaatttttgtatttttttttgtagagatggcggtctcactttgttgcccaggctggtcttgaattcctgagcttaagtgatcctcccacctcagcctcccaaagtgctgggattacaggtgtgagccaccacacccagccaaaaccaggtgttatttgctgactcaccaatgcctcccccaaaaggataaatttaaaggtgtgtataacccatgaagtgtaattcaaataaaacaaattatcgtttggaataataacaactataggtatgtggtcaggaagcagttaaaaacattaaaatacagacctggccagttcaatccaacccaggggttccaagcaggaggtggggcaggtgggcgtcatgccctgtgcttataagggagggcacgtgcacagcagaagcaggttgttccccatttaaagttctggagcccaggctgtgagctccttggctgagccctctcctgtccctgggagctccccaggtgcgaggagcctgccagccagtggggcctacactctgtgttattgcatctccgccaggctaaaagccttggtcactactttagagccactcaaggaaacgcgtgcaccctgccctgctggaaggcaccatggttagagggaggcacactgtttcttagagacggggactgcttgctgtcatgtttcgccttcctcggaagctccatggaatgttctggagcaggcatcttagggcattccctccgcacttctctgccagcccatgtggctcccacactgggctatcccttgccttaggcttgtggccttttttttttttttttttttaatttgaaaaatatttttcatgtgcacttaaacgtgttgtggaatgatgctgggtctcaagaatgctgtgaatcaataaacattttattcagagggtgtctca

SEQ ID NO: 67209 - DNA, 805 bp, Homo sapiens
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggatcggtgcatccagaagaaaatcctgatgcggaagacggaggagcctggcaaatacagcgcctgcttgtccgcagtcgagatggaccagatcacgcctgccctctgggaggccctagccattgacacattgaggaagctgaggattgggacaaggaggccaaggattagatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcccggaccacctggacctaccctccagccatgacccttccctgctcccacccacctgactccaaataaagtccttctcccccaaaaaaaaaaa

SEQ ID NO: 67210 - DNA, 565 bp, Homo sapiens
cgcccagtgacctgccgaggtcggcagcacagagctctggagatgaagaccctgttcctgggtgtcacgctcggcctggccgctgccctgtccttcaccctggaggaggaggatgagggaggatcggtgcatccagaagaaaatcctgatgcggaagacggaggagcctggcaaatacagcgcctatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcccggaccacctggacctaccctccagccatgacccttccctgctcccacccacctgactccaaataaagtccttctcccccaaaaaaaaaaa

SEQ ID NO: 67211 - DNA, 699 bp, Homo sapiens
cgcccagtgacctgccgaggtcggcagcacagagctctggagatgaagaccctgttcctgggtgtcacgctcggcctggccgctgccctgtccttcaccctggaggaggaggatatcacagggacctggtacgtgaaggccatggtggtcgataaggactttccggaggacaggaggcccaggaaggtgtccccagtgaaggtgacagccctgggcggtgggaagttggaagccacgttcaccttcatgagggaggatcggtgcatccagaagaaaatcctgatgcggaagacggaggagcctggcaaatacagcgcctatgggggcaggaagctcatgtacctgcaggagctgcccaggagggaccactacatcttttactgcaaagaccagcaccatgggggcctgctccacatgggaaagcttgtgggtaggaattctgataccaaccgggaggccctggaagaatttaagaaattggtgcagcgcaagggactctcggaggaggacattttcacgcccctgcagacgggaagctgcgttcccgaacactaggcagcccccgggtctgcacctccagagcccaccctaccaccagacacagagcccggaccacctggacctaccctccagccatgacccttccctgctcccacccacctgactccaaataaagtccttctcccccaaaaaaaaaaa

SEQ ID NO: 67212 - DNA, 338 bp, Homo sapiens
gaggattgcatgaggccaggagtttgagcccccatctttaaaaataaaataaaacttgaaaaaaaaaaagaatggccgactttattctaaaagcactgagaaatcgcttcatagttttaaacagggcagtgacttgctcagtatatccttgccttcaagaactcattccagtttcagctaccaagtctactctcagatttggatctctggccctgacttccctcagtgttccaggctacattgcttactccctttttttgagacggagtctcgctctgtcgcccaggctggattgcagtggtgcgatctcagcttactgcacccttcacctcctgggt

SEQ ID NO: 67213 - DNA, 733 bp, Homo sapiens
aacaatattaacatcaccttttggtagataaggaaagtctaagaccggacaacttgttcaaggacacaaagccaacatgtgttagaaccaggacctgccggatcagtcacataaggcttagaggatcaaggatcctgcccagatgacttaccgaaatgttacagattaagttggtgtggtaacctgggctgagcactctgggagaggaagagaagagagaagacaggaaacaactgaactatgaccaatcccagcacggaggcccagaaaactttaagatttgagtattaatgtctcaaggtcaggagcaacctcaaggctaaaactcagatctcaggactcaatttcacagaagttccactataaaggcaataatctaaagctttaaatgatatgaaaattttgtaataagagttcagtatttctgccaacattggcgcatggattgcaaagttcacaggattgaaaacaccatcgacataatggaaattgaacagcatctgattactgagtgctatatcagcaagttaaaaggatcttttgcataccttttaatggtatatatcctaaaactgaagtgttcaatatagacatccagattgaaactcaggcagtgaattacatacacaacaaatcagttgaacatggcagagcttgtcagacttatgaaagattaaatacattttacatttcaaaaaaaaaagtcgacgcggacgcgaatttagtagtaata

SEQ ID NO: 67214 - DNA, 711 bp, Homo sapiens
aacaatattaacatcaccttttggtagataaggaaagtctaagaccggacaacttgttcaaggacacaaagccaacatgtgttagaaccaggacctgccggatcagtcacataaggcttagaggatcaaggatcctgcccagatgacttaccgaaatgttacagattaagttggtgtggtaacctgggctgagcactctgggagaggaagagaagagagaagacaggaaacaactgaactatgaccaatcccagcacggaggcccagaaaactttaagatttgagtattaatgtctcaaggtcaggagcaacctcaaggctaaaactcagatctcaggactcaatttcacagaagttccactataaaggcaataatctaaagctttaaatgatatgaaaattttgtaataagagttcagtatttctgccaacattggcgcatggattgcaaagttcacaggattgaaaacaccatcgacataatggaaattgaacagcatctgattactgagtgctatatcagcaagttaaaaggatcttttgcataccttttaatggtatatatcctaaaactgaagtgttcaatatagacatccagattgaaactcaggcagtgaattacatacacaacaaatcagttgaacatggcagagcttgtcttgcaaatagaaccttataactgtcagagtttccacaaaaaatggtattaaa

SEQ ID NO: 67215 - DNA, 380 bp, Homo sapiens
tcaatttcacagaagttccactataaaggcaataatctaaagctttaaatgatatgaaaattttgtaataagagttcagtatttctgccaacattggcgcatggattgcaaagttcacaggattgaaaacaccatcgacataatggaaattgaacagcatctgattactgagtgctatatcagcaagttaaaaggatcttttgcataccttttaatggtatatatcctaaaactgaagtgttcaatatagacatccagattgaaactcaggcagtgaattacatacacaacaaatcagttgaacatggcagagcttgtcagacttatgaaagattaaatacattttacatttccacaagtgtggtattcacaggtctaaa

SEQ ID NO: 67216 - DNA, 474 bp, Homo sapiens
caatgttggctcacttcaagccctgcctcccgggttcaagtgattctcctgtctcagccacccaagtacctaagattacaggcatgcaacaccacacccggctaatttttgaatttttattaatagtagagatggggtttcaccatgttggccaggctgatctccaactcctgacctcaagtgatccgctcgcctcagcctcccaaaagtgctgggattacaggcatgagccaccgcgcccagccactctctcctgattctgaccatgcactttgctctaaatatttcacatgacaagtttccgtaaagatttagtttgaataaaaaattactatgaacgaaaaaaatatataaaagtttgaaataatcttacaacaaacccctgtgacatgaatttacctatataacaaacctgcacatgtacccttaaaataaaagttgaaagttaaacctaaaataaaagttaaaagtttg

SEQ ID NO: 67217 - DNA, 1263 bp, Homo sapiens
ggcgtgagccaccacacccagccatatggaaacatttcagatatcctaatattaaaatgatatttcacaagactggacagttattaactcatgtgaaaggaaaatcttggggccccaaaatcactaagctaaaggaaaaagtcaagcttcggagaactgcttagggcaaacctgcctcccattctattcaaagtcatccctctgctcactgagataaatgaatatctgattgcctcctttggaaagggtaaccagaaactcaaaagaatgcagtgatttgcctcttatctccctaaaacctggaagcccgccccctgttttgagttgtcccacctttgcttcaagtcgtcccaccttttctggactgaaccagtgttcatcttacacacgctgattgatgtctcgtgtcttcctaaaatgtacaaaaccaaactgctctgaccacctcgggttctgacctcctgaagctgtatcatgggcacgcatcctcaaccgtggcaaaataaactttctaaattaactgggacatggctcagatttttagggttcacacgcaaaacccacaaattatccttaatataattatataatatatatttatgtagttagatctggttggtggtagatactaatacacttttgcccaactaagtgtaaaacacattaaatctgtatagcaatctctagactattacacaaaattaactactaactagaaaacacagtatattaaattctcttaagtgtggaaaaatggagaaggaagaataaccttttctctcctcccgtggtcctaatacacagaacagcgactgggaaactgccactagaaaaagatgactgtccaactaaaacctgcatacacagctacatccttccctggaagagcacagtggaactagatcctagtacagatagcacagggattgtcaacattcttgtcacactgaaatttccttctactgatctccaagtaagtaactaacagctgaaacttggaatttatatatcagcacagcacgaagactatagatatatctagtcttatgtaagtttcatattgtgtgataaatgtattgcccccccccgcccccgaatgccggccccttgagaaatatatttttacagggtagaatttctaatatatataaaatgcataatgttaaataatgtttatatattaatatgttatatactaatattaaatataaaatatactgcatattatatttttaatataaaatgtatattattgcattgatt

SEQ ID NO: 67218 - DNA, 366 bp, Homo sapiens
aattttgtgtcctgtaggaaatgcttccttgggtgtttgtattatagcccaatccaagtcatccctgagaacatccccaggttgtaaggattagtcagaagtcatgatgactgttctatataaatatttggcctattaactaaaattagtacctttccatttcttctctttcttgggcggggcagcgggggagtgcaggggaggggaaatagggaacgttcaattgtgttttaagtaatgctcataaaattcttagccaaagatgatcttgccctccaccttggtgacccaccgcatacggggtacatctatctggcctgtctctaggcctagacagaagaaacagggaggattattgttaacttt

SEQ ID NO: 67219 - DNA, 986 bp, Homo sapiens
  misc_feature (1)..(1): n is a, c, g, or t
  misc_feature (5)..(5): n is a, c, g, or t
  misc_feature (24)..(24): n is a, c, g, or t
ncctngcggaacgactctcttaanctccaccgctacacgaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggtgaagaagacctcagtgtggaagaggacgaggaagtactgactttgttgtatgacccttgtctgaactgttactttgacccccaaacagggaaatactatgagttggtataatgcctccttccggggcagagagcaggcactcccagctggagcagaatagcagttcagggtcgcttaaggagtcaccacaacttatgtgttgggtgaccacaaaatcaacagtaactgagagaaacgaattcattttgtaaataatgttcaacgttaagaatacctatattccttttgtagatgagtatgattttgaaactgaagaaattaatacagaggcaagattttaggagtttgaattggttcttgtttgttctcattctacatataattttgtttatttcagataattttatgtaaacaaattaagagttattcattcaaattttttgcagtgttaatctgtaaatgatggcttgatgtacagaaaatgtatttttgcttaaaagatgcctgggtaccttttattttatggcatttgtattaaaaataaagtatgatggtaagaagaataaaaaaaaaaatgcttctttt

SEQ ID NO: 67220 - DNA, 990 bp, Homo sapiens
  misc_feature (1)..(1): n is a, c, g, or t
  misc_feature (34)..(34): n is a, c, g, or t
ncctaagcgtgacgtgactctcttccttaaccgncgcaccaggaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggtgaagaagacctcagtgtggaagaggacgaggaagtactgactttgttgtatgacccttgtctgaactgttactttgacccccaaacagggaaatactatgagttggtataatgcctccttccggggcagagagcaggcactcccagctggagcagaatagcagttcagggtcgcttaaggagtcaccacaacttatgtgttgggtgaccacaaaatcaacagtaactgagagaaacgaattcattttgtaaataatgttcaacgttaagaatacctatattccttttgtagatgagtatgattttgaaactgaagaaattaatacagaggcaagattttaggagtttgaattggttcttgtttgttctcattctacatataattttgtttatttcagataattttatgtaaacaaattaagagttattcattcaaattttttgcagtgttaatctgtaaatgatggcttgatgtacagaaaatgtatttttgcttaaaagatgcctgggtaccttttattttatggcatttgtattaaaaataaagtatgatggtaagaagaataaaaaaaaaaatgcttctttt

SEQ ID NO: 67221 - DNA, 472 bp, Homo sapiens
  misc_feature (1)..(1): n is a, c, g, or t
  misc_feature (34)..(34): n is a, c, g, or t
ncctaagcgtgacgtgactctcttccttaaccgncgcaccaggaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggtgggactatgaaaaacgatatgcataagaaaataaaaataatttactataaatagagagaatccaaca

SEQ ID NO: 67222 - DNA, 925 bp, Homo sapiens
  misc_feature (1)..(1): n is a, c, g, or t
  misc_feature (34)..(34): n is a, c, g, or t
ncctaagcgtgacgtgactctcttccttaaccgncgcaccaggaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaagaagaaatgtctggaagtgctacagccattttgcaactgtgaaggcaaaactcacactctaaagatatcaggacaagaacctggaagtgtgggtcctcacttcttccttgagcatctatactcatcctgaactacagtttccagaacacatttcacatgagaagaataagcatcttttgtctacagatcccaaagcatccttggacacaattcagagtttcatgaacttgagcggaaagagattacattttcattttcacaaagccctgagattcagcattcccctgctttgtgagtgtggacggcagaccagggtagtatcagcaatgcttttggttttgtgtgatggtttgctctcaattggcaagccagcaatacaccttcatcgtcctaccctcaggaatatatcaaccctccagccctgttataatttagtttgcaggcatcttgatcaccttttccttccacaagatgtcacactgcttcattacattgatgacattacactgattgtatctagtga

SEQ ID NO: 67223 - DNA, 623 bp, Homo sapiens
  misc_feature (1)..(1): n is a, c, g, or t
  misc_feature (34)..(34): n is a, c, g, or t
ncctaagcgtgacgtgactctcttccttaaccgncgcaccaggaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgcctttaggtcctttgccatccattaagacaaatcagatgcaatttggtgctcaggacaagaaaatgctgttggatgtttggtgtaggcatgggaaaaaaaaactatattctgaaacaagactggttagaaggcagcttcccacattttgagggactggttaaatatgttgagcccaccaatcgttcctcccagtcaacagccggctgagcagcgtccagattcctgtgaaagtttgagtgttcaaggtgggactatgaaaaacgatatgcataagaaaataaaaataatttactataaatagagagaatccaaca

SEQ ID NO: 67224 - DNA, 405 bp, Homo sapiens
cggcccgagggaaagaaaatattcaccaaataaagcagactgtacctattcatgcagccaatctacatattatgcatccgcatcccccacaattcagagtttcatgaacttgagcggaaagagattacattttcattttcacaaagccctgagattcagcattcccctgctttgtgagtgtggacggcagaccagggtagtatcagcaatgcttttggttttgtgtgatggtttgctctcaattggcaagccagcaatacaccttcatcgtcctaccctcaggaatatatcaaccctccagccctgttataatttagtttgcaggcatcttgatcaccttttccttccacaagatgtcacactgcttcattacattgatgacattacactgattgtatctagtga

SEQ ID NO: 67225 - DNA, 998 bp, Homo sapiens
  misc_feature (1)..(1): n is a, c, g, or t
  misc_feature (5)..(5): n is a, c, g, or t
  misc_feature (24)..(24): n is a, c, g, or t
ncctngcggaacgactctcttaanctccaccgctacacgaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggtgaagaagacctcagtgtggaagaggacgaggaagtactgactttgttgtatgacccttgtctgaactgttactttgacccccaaacagggaaatactatgagttggtataatgcctccttccggggcagagagcaggcactcccagctggagcagaatagcagttcagggtcgcttaaggagtcaccacaacttatgtgttgggtgaccacaaaatcaacagtaactgagagaaacgaattcattttgtaaataatgttcaacgttaagaatacctatattccttttgtagatgagtatgattttgaaactgaagaaattaatacagaggcaagattttaggagtttgaattggttcttgtttgttctcattctacatataattttgtttatttcagataattttatgtaaacaaattaagagttattcattcaaattttttgcagtgttaatctgtaaatgatggcttgatgtacagaaaatgtatttttgcttaaaagatgcctgggtaccttttattttatggcatttgtattaaaaataaatagcgatgcgaccgttttgtgtggggcgaaaatggggcgggtgcggggaaaa

SEQ ID NO: 67226 - DNA, 1012 bp, Homo sapiens
  misc_feature (1)..(1): n is a, c, g, or t
  misc_feature (34)..(34): n is a, c, g, or t
ncctaagcgtgacgtgactctcttccttaaccgncgcaccaggaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaaggatgatttaatcccagaaagctggagagcttggagacatccaagatgctgacaaatggaccaccgaagaaaaagcacttagcacatgaagaaatgtctggaagtgctacagccattttgcaactgtgaaggcaaaactcacactctaaagatatcaggacaagaacctggaagtgtgggtcctcacttcttccttgagcatctatactcatcctgaactacagtttccagaacacatttcacatgagaagaataagcatcttttgtctacagatcccaaagcatccttggacacaattcagagtttcatgaacttgagcggaaagagattacattttcattttcacaaagccctgagattcagcattcccctgctttgtgagtgtggacggcagaccagggtagtatcagcaatgcttttggttttgtgtgatggtttgctctcaattggcaagccagcaatacaccttcatcgtcctaccctcaggaatatatcaaccctccagccctgttataatttagtttgcaggcatcttgatcaccttttccttccacaagatgtcacactgcttcattacattgatgacattacactgattgtatctagtga

SEQ ID NO: 67227 - DNA, 728 bp, Homo sapiens
  misc_feature (1)..(1): n is a, c, g, or t
  misc_feature (34)..(34): n is a, c, g, or t
ncctaagcgtgacgtgactctcttccttaaccgncgcaccaggaatatgactggcgaaactatcagccaagccagatgagtgaatccgagttacagatgctagcaagcctacggtggcaacaaaatgaagaactggaggatgctgggacctcccatggcctgagtgcctcccaggtggacaactgtaatgtcagcataagtaccagcagtgacgacacaaccacctggaactcctgcctgccaccccctgtcaaccagggtcgccactatcagaaagaaatgaacccaccttctccttctaatccccgggactggttaaatatgttgagcccaccaatcgttcctcccagtcaacagccggctgagcagcgtccagattcctgtgaaagtttgagtgttcaagatatttcacacactcctgaccaggctgtaacaagatgattttttagacccacttttcatccaaaacaaggatgatttaatcccagaaagctggagagcttggagacatccaagatgctgacaaatggaccaccgaagaaaaagcacttagcacatgcacatgctcaccaaaatgcaataccatgctatggtcgctcattctgtccacaaagattgcagctttctatgcactctaactgcattctgccacctgcaccctgtggcccacttgaaatgaagtttgactacatgacctgcttctttagccaataaaatgtgagcagaag

SEQ ID NO: 67228 - DNA, 648 bp, Homo sapiens
  misc_feature (33)..(33): n is a, c, g, or t
  misc_feature (130)..(130): n is a, c, g, or t
  misc_feature (132)..(132): n is a, c, g, or t
  misc_feature (137)..(138): n is a, c, g, or t
  misc_feature (140)..(140): n is a, c, g, or t
  misc_feature (145)..(145): n is a, c, g, or t
  misc_feature (152)..(153): n is a, c, g, or t
  misc_feature (156)..(156): n is a, c, g, or t
  misc_feature (159)..(159): n is a, c, g, or t
  misc_feature (164)..(164): n is a, c, g, or t
  misc_feature (175)..(175): n is a, c, g, or t
  misc_feature (197)..(197): n is a, c, g, or t
  misc_feature (200)..(200): n is a, c, g, or t
  misc_feature (229)..(229): n is a, c, g, or t
  misc_feature (233)..(233): n is a, c, g, or t
  misc_feature (238)..(238): n is a, c, g, or t
  misc_feature (240)..(241): n is a, c, g, or t
  misc_feature (247)..(247): n is a, c, g, or t
  misc_feature (250)..(250): n is a, c, g, or t
  misc_feature (255)..(255): n is a, c, g, or t
  misc_feature (257)..(257): n is a, c, g, or t
caccacacaaccccaaacccaaccaacagaccnacccccacccccccccccccacccacccaaccccccaaaccccccaccccaaccccacacccaccaaccccacacccaccaacacaccccccccccncnccccnnangcaangaagcanncanacncccgnaaccccgcacnccccacgaaccagaaagagcancgncggaggggaaggaaaagggggggaaaganaatnccccncnnggcatnaanccaantntttaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67229 - DNA, 684 bp, Homo sapiens
tctgggctcccctgggcggggcctgtccctcactcttaggcccagaacctgtccaagggacaggtagggtccaggtcccactttgggtagctgcctgtttggaatgcccacactggtgctgcctgtggcatagccactgctgtacgtttttggttgtttttaagaaactcgatgaagaggggtgtcattctgggctcggggtggtcgccaatttttcaccagaaagggagccaccccttgcaaccacttctgtctccgttagccccccctctgccctcctccaagccaaagcgtggcctggcttttgtcttcccatttagttttcctcttttacccttccttttgtgcttaatttattaaaatagttgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccagcgtgagtccctcgtcatctgtcgctaggatattacgtgc

SEQ ID NO: 67230 - DNA, 593 bp, Homo sapiens
  misc_feature (574)..(575): n is a, c, g, or t
tagtagaaacggggtttcactgtgttagccaggatgttctcgatctcctgacctcgtgatccgcctgcctcggcctcccaaagtgctgggattacaggggtgagccaccgtgcctagccatttcattttaattaacttaaatttaaatagctccatgtggttagaggatactgaattagcacagtcttagagagttccttcttgttccatggactggacacaatgaagattaacagtaattaaggtcacttctggtttagatgtgctttatctgagaggaaaattcagccagcaaacatacaaaaagaaagcacagtgtgaagttcggtgttaagagctagtttgcctgcgtttgaaccctgcctggctctgccatttcctaccacttaactgcactgtggctgagttttctgatctgtaaggtgggaataataatgatacctatctcataggggaatgaaaggatcaaatgagttcatatttgtaaagcaatttgaaagagtgcctagcccacagtaagtgctacataagagtttgttaaatgaatctgcaaaaaaaaaagtcgaccggccgnnaatttagtagtagtaggc

SEQ ID NO: 67231 - DNA, 768 bp, Homo sapiens
tagtagaaacggggtttcactgtgttagccaggatgttctcgatctcctgacctcgtgatccgcctgcctcggcctcccaaagtgctgggattacaggggtgagccaccgtgcctagccatttcattttaattaacttaaatttaaatagctccatgtggttagaggatactgaattagcacagtcttagagagttccttcttgttccatggactggacacaatgaagattaacagtaattaaggtcacttctggtttagatgtgctttatctgagaggaaaattcagccagcaaacatacaaaaagaaagcacagtgtgaagttcggtgttaagagctagtttgcctgcgtttgaaccctgcctggctctgccatttcctaccacttaactgcactgtggctgagttttctgatctgtaaggtgggaataataatgatacctatctcataggggaatgaaaggatcaaatgagttcatatttgtaaagcaatttgaaagagtgcctagcccacagtaagtgctacataagagtttgttaaatgaatctgcaaaaaaaaaaaatttacaaaaaggtacctaagggtccgggtgactatatgcttccatcaagactagtgaagaatggttgttttttccattcatccctacatttctttttttaataatgataaacatgcaacttttttgtagctttacaacaaatacccagatgctgtggccacatggcgttacgtcgagtccacagtcgaagggatccatctaggca

SEQ ID NO: 67232 - DNA, 1516 bp, Homo sapiens
  misc_feature (2)..(2): n is a, c, g, or t
  misc_feature (11)..(13): n is a, c, g, or t
  misc_feature (16)..(16): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67233 - DNA, 1858 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgccta

SEQ ID NO: 67234 - DNA, 1913 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
  misc_feature (1907)..(1908): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctaaaaaaaaaaaaaaaaaaaaaaaaaaaaaaaaaaaaaaaaaaaaaaaagnnggggg

SEQ ID NO: 67235 - DNA, 1828 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
  misc_feature (1786)..(1786): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataaggatgcgncagttttcctcgttcttgtcaataattgaaacaatgaataca

SEQ ID NO: 67236 - DNA, 1797 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaatattttaaaaaaaaaccaaaaa

SEQ ID NO: 67237 - DNA, 1996 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataaaaaaaaaaaaaaaaaaaaaaaaaaaaactttgttggggggctgcgggccctggaaaaagtttttaaaaccatttggttggggggggggggcccaagtaggtttaggtggacctggggcaaaggggccccaaggaaaacggggcaggaaaaggggtgggttttttccccaataaaaagggcggggggacgcgggggttggacaactcagtgggtttggg

SEQ ID NO: 67238 - DNA, 1753 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgatacaaacacccccccgagcttgagta

SEQ ID NO: 67239 - DNA, 1652 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
  misc_feature (1633)..(1634): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaagtcgaccggccgnnaatttagtagtagtaggc

SEQ ID NO: 67240 - DNA, 1592 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaagcctaacgatgtatgattatgtagatatagcagacgcgtagtttttcctcaagag

SEQ ID NO: 67241 - DNA, 1605 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
  misc_feature (1445)..(1445): n is a, c, g, or t
  misc_feature (1453)..(1454): n is a, c, g, or t
  misc_feature (1600)..(1600): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagttatggngaggttcnntgggtgcaaaacatgggggataggtggggccggaccggaaaagcaggggtgggtttaaagacaaaggtttgttctcgggattgggaaaccaaaatttctttttgtttgttttaaagcgccggggtggttgtgttctcgctttgggnggccc

SEQ ID NO: 67242 - DNA, 1859 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
  misc_feature (1416)..(1416): n is a, c, g, or t
  misc_feature (1437)..(1437): n is a, c, g, or t
  misc_feature (1454)..(1454): n is a, c, g, or t
  misc_feature (1456)..(1456): n is a, c, g, or t
  misc_feature (1473)..(1473): n is a, c, g, or t
  misc_feature (1478)..(1478): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatccccccccccccacccacccaaccccccaaaccccccaccccaaaaccaaacagnacaccaaaccccccccccccnccccatccggccgaatncncacccatttgaccccgnaaatnaccaatgtgtcccacaaacagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgccta

SEQ ID NO: 67243 - DNA, 1245 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactccccagcagtgagggtctctctcttccccttgtgctcttgctggggctgg

SEQ ID NO: 67244 - DNA, 1724 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67245 - DNA, 1435 bp, Homo sapiens
  misc_feature (2)..(2): n is a, c, g, or t
  misc_feature (11)..(13): n is a, c, g, or t
  misc_feature (16)..(16): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67246 - DNA, 1393 bp, Homo sapiens
  misc_feature (2)..(2): n is a, c, g, or t
  misc_feature (11)..(13): n is a, c, g, or t
  misc_feature (16)..(16): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67247 - DNA, 1421 bp, Homo sapiens
  misc_feature (2)..(2): n is a, c, g, or t
  misc_feature (11)..(13): n is a, c, g, or t
  misc_feature (16)..(16): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67248 - DNA, 1221 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccaggtaaatcctttaacagacacacctgatggttctgactagcgctcaagtctaggaaaccacagtttgcatattcattcattcattcatccattcattcatccattcagcaagaattcattcatattctactttatgaccattgaatacaaatctttttctgcttggcggtttttgtaagtctacataatttctctctagatttgattctcaaacacaattctactttttgaaatcctggatcagttattttcagattaaaataaatggaaaacaccaattattt

SEQ ID NO: 67249 - DNA, 918 bp, Homo sapiens
  misc_feature (2)..(2): n is a, c, g, or t
  misc_feature (11)..(13): n is a, c, g, or t
  misc_feature (16)..(16): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccaggtaaatcctttaacagacacacctgatggttctgactagcgctcaagtctaggaaaccacagtttgcatattcattcattcattcatccattcattcatccattcagcaagaattcattcatattctactttatgaccattgaatacaaatctttttctgcttggcggtttttgtaagtctacataatttctctctagatttgattctcaaacacaattctactttttgaaatcctggatcagttattttcagattaaaataaatggaaaacaccaattattt

SEQ ID NO: 67250 - DNA, 375 bp, Homo sapiens
  misc_feature (2)..(2): n is a, c, g, or t
  misc_feature (11)..(13): n is a, c, g, or t
  misc_feature (16)..(16): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagggtatttttaaacttctcataattaaactacagtgatgaaagatagccacactcaggccatttg

SEQ ID NO: 67251 - DNA, 338 bp, Homo sapiens
  misc_feature (2)..(2): n is a, c, g, or t
  misc_feature (11)..(13): n is a, c, g, or t
  misc_feature (16)..(16): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagtcgaaggggatcctcaagagtcagctc

SEQ ID NO: 67252 - DNA, 536 bp, Homo sapiens
aaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctaataatgtttttaaaggttta

SEQ ID NO: 67253 - DNA, 651 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgctttgccgtcctagacagtcacccctgtgttctcattgatcacgctaagagactagggtcgttggcttgctggaaacgttattcttgaggaacaacgtcggattctacatagcaataatagcgcgatgatgcggggtggccctccattggctaaaacctctgtagcacccagtctcagaagcagaatctcctagccccacagaaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccaaggtagacacgagagacaaggtagagccgaaaacaaggtagaccga

SEQ ID NO: 67254 - DNA, 1777 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67255 - DNA, 1886 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
  misc_feature (1880)..(1881): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctaaaaaaaaaaaaaaaaaaaaagnnggggg

SEQ ID NO: 67256 - DNA, 1830 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataaaaaaaaaaagcacggcggcgccgagaaaaaggaatataaagaatagcagaag

SEQ ID NO: 67257 - DNA, 1895 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
  misc_feature (1889)..(1890): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatactttttataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctaaaaaaaaaaaaaaaaaaaaaaaaaaaaaaaaaaaaaaaaaaaaaaaagnnggggg

SEQ ID NO: 67258 - DNA, 1719 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaattaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67259 - DNA, 1778 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
  misc_feature (1416)..(1416): n is a, c, g, or t
  misc_feature (1437)..(1437): n is a, c, g, or t
  misc_feature (1454)..(1454): n is a, c, g, or t
  misc_feature (1456)..(1456): n is a, c, g, or t
  misc_feature (1473)..(1473): n is a, c, g, or t
  misc_feature (1478)..(1478): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatccccccccccccacccacccaaccccccaaaccccccaccccaaaaccaaacagnacaccaaaccccccccccccnccccatccggccgaatncncacccatttgaccccgnaaatnaccaatgtgtcccacaaacagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67260 - DNA, 1474 bp, Homo sapiens
  misc_feature (2)..(2): n is a, c, g, or t
  misc_feature (11)..(13): n is a, c, g, or t
  misc_feature (16)..(16): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67261 - DNA, 1555 bp, Homo sapiens
  misc_feature (2)..(2): n is a, c, g, or t
  misc_feature (11)..(13): n is a, c, g, or t
  misc_feature (16)..(16): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgccta

SEQ ID NO: 67262 - DNA, 1461 bp, Homo sapiens
  misc_feature (2)..(2): n is a, c, g, or t
  misc_feature (11)..(13): n is a, c, g, or t
  misc_feature (16)..(16): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccaatcaacaggctgattctggaagatctgaggacccatctgagaggcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67263 - DNA, 877 bp, Homo sapiens
ccacgcgtcgcccacgcgtccgctgacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaata

SEQ ID NO: 67264 - DNA, 955 bp, Homo sapiens
  misc_feature (54)..(55): n is a, c, g, or t
  misc_feature (57)..(57): n is a, c, g, or t
  misc_feature (64)..(64): n is a, c, g, or t
  misc_feature (67)..(67): n is a, c, g, or t
  misc_feature (101)..(101): n is a, c, g, or t
  misc_feature (114)..(114): n is a, c, g, or t
gaacagcaggatgaggtacaatacagtatctatcggaccagactcgtctcagcnnangttcagnctnctcagccaaacgccgaccaaggaaaactcactancatgagaattgcngtgatttgcttttgcctcctaggcatcactgtgccataccagttaaacaggctgattctggaagttctgaggaaaagcagctttacaacaaatacccagatgctgtggccacatggctaaaccctgtcccagtctcagaagcagaatctcctagccccacagaacactattgtctacggaaggagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcggacataacttacacattgaaagccaagaagttgattgtgcatacaaggct

SEQ ID NO: 67265 - DNA, 684 bp, Homo sapiens
  misc_feature (2)..(2): n is a, c, g, or t
  misc_feature (11)..(13): n is a, c, g, or t
  misc_feature (16)..(16): n is a, c, g, or t
  misc_feature (622)..(622): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtccaaaatctttaagaaagtttntccgcagaacccttggacaatctccaagtaccccctgggttggcttcccaggacggaaggga

SEQ ID NO: 67266 - DNA, 349 bp, Homo sapiens
  misc_feature (2)..(2): n is a, c, g, or t
  misc_feature (11)..(13): n is a, c, g, or t
  misc_feature (16)..(16): n is a, c, g, or t
tnagtacccgnnnttngggcattcttggcctactggtacagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgttgtcgctagggggtcctcagagcgccgcac

SEQ ID NO: 67267 - DNA, 533 bp, Homo sapiens
tctcaggtaaacctattgaccattgtgccttcttgtgtgatttacaataacataatatttatgtatacacagagagcttttgcaatagaaggtgtgccttgagaactgcagagtgcgtcttccctgaacctaacaccggaccagagttaagagttgctcaataaatgcatgttgaattaatttcactttttctttttctagaggatctctattgctcaggctggagtggtggggtacaaccatggctcaccgtggcctcgactcccaggctcaagcgatcctccctcttcagcctcccaagtagctgggaccacaggcatgccaacatgcctggctaattttttaattttttgttgagacaaagtcttgctatgttgcccgggctggtcttgaactcctgggctcaagcatttctcctgcctcggcgtttcaaagtgtgagatgataggtgtaagtcactatgctcggccggatttgattttagaccctggggaacccatctttggactgtttctcaaagagagggcagatat

SEQ ID NO: 67268 - DNA, 2492 bp, Homo sapiens
acgggggcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattctttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaacgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaaccagtttgagaatca

SEQ ID NO: 67269 - DNA, 2239 bp, Homo sapiens
acgggggcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattctttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaa

SEQ ID NO: 67270 - DNA, 2070 bp, Homo sapiens
ctcccgtcggtcgcttgctcacgacgcgctctctctttcttgtagcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattctttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaa

SEQ ID NO: 67271 - DNA, 1923 bp, Homo sapiens
ctcaggcctgttctgaagattcggaaagatgccatgtgagagtcgcatgcagccagacacagagcgacagtgcgcgccggctgctgctgtcaccttcactgtcactgttactgtcgttcatcctgatggtgggaagaggagacaagcaggactccaggaccaaggaacaaagcattcttagctttttttcatggtagaaaaatcctgttaaaatggcttcacatgtcgcttacttttttaaaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattctttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaa

SEQ ID NO: 67272 - DNA, 383 bp, Homo sapiens
tttttcatggtagaaaaatcctgttaaaatggcttcacatgtcgcttacttttttaaaggatgccctgcacagcgtaaagaagagacttttaagaaatacagagcggagattgtcctgctgctggctctggttattttctacttaacactcatcattttcacttgtgtaagtatcttcttaaaacatcttctcttattaaaagattacccagggcaccaatccaagtatctcttgcagatagtgcgaatcatttaataatggtgagagagattattctttgaaccctggactttttgaggcccctagactgggagaatcattacaggaagctccctgaaatatttccagcttttgtctagtggctacgtttagagcattgtgg

SEQ ID NO: 67273 - DNA, 2435 bp, Homo sapiens
acgggggcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattctttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaacgaacccccatgatgtaagtttacctatgtaacaaacctgcacttatacccatgaacttaaaatgaaagttaaaaataaaaaacatatacaaat

SEQ ID NO: 67274 - DNA, 2627 bp, Homo sapiens
acgggggcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattctttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaaaaaaaaacaaaaaaaaaaaaaaaaaaaaatgaaaaaaaactaaatcaaaaaaaatctaaaatacatcaaagtttatgcctgaaggatacaattagagtttacattggccaattcgccctataacgaatttaattacaaataactaaaaaacaattttaccacgttggacctggacaatttttgctgtacttatttttatcgctgcccaatatatgccgcctttggtgaagatcccctctttggggggggcgaaaaatctatcgggcccctatataatacacctttcttgtggaaaacacgggggtttgccagattataaaagctgttgaaaattcacctttttatctcacgtggggtttacataagggagccaccggtctgtttttct

SEQ ID NO: 67275 - DNA, 2185 bp, Homo sapiens
acgggggcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattctttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaa

SEQ ID NO: 67276 - DNA, 355 bp, Homo sapiens
catcatccattggttctggatttaacatacaaaatccgtaaaagaactgaaatgttctgaagcttgaatctctctcatgcagttattctgttggatgaagtggcatttcaaatttgctcactcagatttgggacattagtctcattctgaagcacaccaatgcttccagaactaccagcatgctgtaatgaaaggctagtaacacagtcagaagaggaagcaaggttggtttgacatgacttgctcttgatgcataaagctttggtgcttccttgtcacctgatactataaataacattccaaactttttaataaaatgttttattcccttatgtgggaatattattaactagta

SEQ ID NO: 67277 - DNA, 621 bp, Homo sapiens
catcatccattggttctggatttaacatacaaaatccgtaaaagaactgaaatgttctgaagcttgaatctctctcatgcagttattctgttggatgaagtggcatttcaaatttgctcactcagatttgggacattagtctcattctgaagcacaccaatgcttccagaactaccagcatgctgtaatgaaaggtaccgccatgagacttgaagaagtatctgactttgtcccaaaatctatctgaataagaaaaacggacaaacaaaaagataaggagaagaaagaggaaacaaaagctaaaaggttcaccttaactttcccagcattttcgtcatcttcttttttgtcttcaaattcaaaggcaacagtcatgcgttgttgtctctgctcttcccacagtgtagggttaaagctgtcactgtctgactggaaatctacagttagattccaaagtattattgtttttttaaaaaacaattttacacaaagtatttaatatagtatgcaaaaatggtgatagatactacaaacaaatacggaaataaagaagaaagaaagaaaaaaagaaagagaaagaaggaaagagaaaagaataaaattcccttgatatttattaca

SEQ ID NO: 67278 - DNA, 6220 bp, Homo sapiens
  misc_feature (12)..(12): n is a, c, g, or t
  misc_feature (14)..(14): n is a, c, g, or t
  misc_feature (167)..(167): n is a, c, g, or t
  misc_feature (319)..(319): n is a, c, g, or t
  misc_feature (347)..(347): n is a, c, g, or t
  misc_feature (464)..(464): n is a, c, g, or t
  misc_feature (500)..(500): n is a, c, g, or t
  misc_feature (558)..(558): n is a, c, g, or t
  misc_feature (727)..(727): n is a, c, g, or t
  misc_feature (744)..(744): n is a, c, g, or t
  misc_feature (881)..(881): n is a, c, g, or t
  misc_feature (920)..(920): n is a, c, g, or t
  misc_feature (992)..(992): n is a, c, g, or t
  misc_feature (1207)..(1207): n is a, c, g, or t
  misc_feature (1422)..(1422): n is a, c, g, or t
  misc_feature (1447)..(1447): n is a, c, g, or t
  misc_feature (1505)..(1505): n is a, c, g, or t
  misc_feature (1512)..(1512): n is a, c, g, or t
  misc_feature (1556)..(1556): n is a, c, g, or t
  misc_feature (1731)..(1731): n is a, c, g, or t
  misc_feature (1746)..(1746): n is a, c, g, or t
  misc_feature (1807)..(1807): n is a, c, g, or t
  misc_feature (2055)..(2055): n is a, c, g, or t
  misc_feature (2157)..(2157): n is a, c, g, or t
  misc_feature (2337)..(2337): n is a, c, g, or t
  misc_feature (2388)..(2388): n is a, c, g, or t
  misc_feature (2442)..(2442): n is a, c, g, or t
  misc_feature (2530)..(2530): n is a, c, g, or t
  misc_feature (2826)..(2826): n is a, c, g, or t
  misc_feature (2914)..(2914): n is a, c, g, or t
  misc_feature (2920)..(2920): n is a, c, g, or t
  misc_feature (2957)..(2957): n is a, c, g, or t
  misc_feature (3034)..(3034): n is a, c, g, or t
  misc_feature (3182)..(3182): n is a, c, g, or t
  misc_feature (3230)..(3230): n is a, c, g, or t
  misc_feature (3362)..(3362): n is a, c, g, or t
  misc_feature (3491)..(3491): n is a, c, g, or t
  misc_feature (3710)..(3710): n is a, c, g, or t
  misc_feature (3740)..(3740): n is a, c, g, or t
  misc_feature (3815)..(3815): n is a, c, g, or t
  misc_feature (4176)..(4177): n is a, c, g, or t
  misc_feature (4180)..(4180): n is a, c, g, or t
  misc_feature (4182)..(4182): n is a, c, g, or t
  misc_feature (4197)..(4197): n is a, c, g, or t
  misc_feature (4512)..(4512): n is a, c, g, or t
  misc_feature (4515)..(4515): n is a, c, g, or t
  misc_feature (4619)..(4619): n is a, c, g, or t
  misc_feature (4622)..(4622): n is a, c, g, or t
  misc_feature (4708)..(4708): n is a, c, g, or t
  misc_feature (4880)..(4880): n is a, c, g, or t
  misc_feature (5001)..(5001): n is a, c, g, or t
  misc_feature (5105)..(5105): n is a, c, g, or t
  misc_feature (5149)..(5149): n is a, c, g, or t
  misc_feature (5200)..(5200): n is a, c, g, or t
  misc_feature (5428)..(5428): n is a, c, g, or t
  misc_feature (5458)..(5458): n is a, c, g, or t
  misc_feature (5708)..(5708): n is a, c, g, or t
  misc_feature (5872)..(5872): n is a, c, g, or t
  misc_feature (6034)..(6034): n is a, c, g, or t
attacaggcgtnanccaccatgcctggcaacataacatttatatgcaccagaaagcaaaaaatttcgtgtgacttgcgctgttgtgacattcaccttattgtgttacctagaaccaaacctgcaatatctccaaggtgtgcctgtatccctagaagcagagctggantaaggacttcggtgtgggtggtttatttggaaagtgattccaagaagcaagagtcagaagtgggaagagtgagccaggcaagaaagaaaagccaaaataatggcatgctattgaggctcctgccatgcagttttttctgcaggaccttccgngaggctccggaaagttatccagaaatgnccacctgaaacatgagcctggagcatttgtccacctgtcccacactggttgaggtcttcccctgaggctgttaacctgcaagtgtttctgggctgtatttgtgctcaggcaaaatcntacaataatggagattccctagggcagaaagtgtancttgagtttgctggcagcacaagagaagcctgtgcttccatggaacttctcacggtgnctgagactgaatgaaaggtgagctgagaaaacatgacgcaggcgccattgcactaagcaatcatagccatcgatctgggcaagaggacccctgccctgaatcctgcacttgagaaggtgcctctctggccctccactgactgtaccctggcccactcagagcttcaccntctcttctagggcacangctgggcactcagggacctggcgaaatgtgcctgagcctgcatggcctcttccctgggtccatttcaaagtgcaaactgtgcttgtccaaatggtgcccaaggatctgctttctgaaggggtgagaattgtggatgnagcttgcatggggcctagggagttccccacacaagggtntgcaaagcttctcaagtgaggacagggctacctacgatgaaagaaaaaagtttagcctggggctgatgatcngctctccctttactaccacattcctgtgcagagcaccaagaaatcagagaattctacactcaactttgaccttgtgggttattatggcagtatatttatcgaaataggagaatagaacatatttaactatttgttagcttcatttataactcataattatttagacataatgcaaatgtgggctggaatttacgttctgattttttgtggccttnagctaaggaaaagggacccaaggaaatgggctttatatgcttggatggctttgtggaatccccaacttcattagcttctgtggtgactcaagattgttactaaaatccactttgtattatctttaaaaaccaaggaatattatgtagatcagtagttagaaggtacttgactcaaaatatgtatgaaccaaaggatataaatgactaaaagcagnaggattattacctgaagtggtgganggttgatctcaggatatgacctgtgagatccttcctgctggctcagtgctggctgaanggggggnaggagagcaccaggaacaacacacatctgggacaggagggaatncggggaggaaggaaagagaaataggcctttttatttttattgatacatgacaattatacatatttgtagggtacatgtgatattttgatacatgcatacaatgtgtagtgatcaaatcaggataatttgcatatccatcacctcaaacatttatcatttgtgttgagaacattcnacatctttcctctantcattttgaaatatataagttattgttaatgatcatcaccctacgtgctattgaacactanaaatttttctgttccttccatctaactgtatttttgtgtccattaaccaacttctgggaagggcaaaagagtgggtggatgaaaagggccctttttaaggaaaagtaaatcttacaagaagggaagacatcttaggaggaaaaataaaaaggtggaccatgggcttagagtagggactgcagaaattgaatggcaaagaaaaaaccaacttagcaatgtgaaaatacatctcaatgtcattcttttcncaggtccagtgtctgattcttttgggaagctggatatgaagtcagaatctttctttgagtcatacattttcatgattatgattattattgaatgatagctgncaattattgagagcaattattgaggacaattattgagctttcacaagcccttttcaaggtctttacatatattttctccacttctaactgttagatattcttattattcccattttgtagatgagggatacacaggcataaagcctatgtggaggcagagagcagctacgtaacctgacnatggcccaacagcaaacaaatgatggggccacatgcaaatccaggcagaanccttctattatatgaagctcaatgttttcttgtttgcagcttgttatgaatacntctatttgcaaatgggttttgaagctactttaaaacattttgtggctgtgcgtggtggctggcacctgtaatcccagcattatggganaccaaggtgggcagattgcctgagctcaggagtttgagaccaacctggccaacatggtgaaaccctgtgcctactaaaaatacaaaaaaattagccaggtgtgttggtgtgcacctgtaatcccagctactctggagggtgaggcaggagaatcacttgaacccaggagaggaaggttgcagtaagctgagatcatgccactgaactccagcctgggcaacagagtgagattctgtctccaaataaaaaataaataagattgaattttgagctcctgaccatgtccctagattgtnctcatatgtattttgatgtctaataagatttattctcagtgcattttttaagtgaaagtatttattgagcatctactgtatatcatgngctganataggcaccagtggtgcagggaacatatggcacagtntctgacctcaggtaactttcactctcatacatatgtattaggacaccaacacatgtgtgaatataagatagtatganagatattgcaacaagtaattatttactgtaaacctattttataggattttaaacttaaactactttcaccctatttccaaaaaaaagtattgcataactttaaatagattctcagtttgaaatcatcatacaaactgcagtagcatcngctggtgaaatactgctttgtatctattagaatagtccaaacaattgngagacaactgcattattagagctgtaaaagttattgtctagaaatctcagagaagaagaggaagttctatggtagatgaataagatgacatctaaactgttctcttcagctactgaagttctgtggatatcncacagcacaaagttcaagtgtatgcccacagctcctcatgccacaagatgtgacacctttccaatctctttttgcaaaagtttccaattatgtctcttttaagagtactttttatacccacatattccngattttgtggtgcacgcaaagacaagatgggaaggggcttccatttattgatgccagctgctccatggaccaggccctgcccatgcatccatgttggttcttttatccccacatcagccatagcccataagcattaactgccattgcacagatgaggaaattgaaagtctaagagaatatgcaatctacccagagtcatgcagcttgtgtatgtaaggnttggaatgaaaatccaatctgtgtgagtcncaagtccccttccaccatatggtttccatttcattttgcaatcagattggctgggatatgtctgccctaaaaganagtaagtaggaatatttgtctctataccttaacctgacatccatgggcttgctttttgtatttggaggtgtcataacattataataataatttgattttatttgtacagtggatattatactactcagtctagagatttatgacatcccagtctaaactggatgatagcaatgaagcttcttcaaggagacaagtatgagtaataaggtagtaataagctgaatttctatggagttgctacttctgaattaaaactagttgagattaagtagatattcaaaaatattgctataatcttcacttgaataatacaaacatttattatttttacatatttatttatttatggaacataattttnnaananaatattttcaaattntattaaaatatattaaaaacataatacattatcacccaatagagtttttcaaagtaactcagtgttagtttaaaatgtgaaattcaatcaacataattcaccatagaatacagtgtgtatgtcagtataatatatatatcaaaattggaaagcagtaaatttatctttgttttgtaataagatgaaattaaaattttaatgaatttcaactttcattttagatttcggagggtacctttgcaggtttattacatgggtgtattgtgtgatgctgagatttggggtatgaatgaaagtgtgagtgcctgttttganctngcaccgagagcaatctcccctgatcagcagagggtaaactaacttgaattacacttgaattttttagtagagcaggtcacaaagggcaaattgtagtccagagncanaagtgctcagtggtctaaaatgagcctgccatatcactgagggtacaggtcttcacagaaatatatttcagaaagacgtcaaaccnttgtttaaagataaatgtaagctgggtgtggaggcacacgtctataattccagctactcaggaggctgaggcaggaggatcccttgagttcaggagtttaagaccagcctggacaacataggaagatcccatctcaattttttaaaatgagaaaaaaatagataaacttaancatattaaaattttaaagagtttatttaagcaaacagagattcatggatcaggcagctccaaactgaaagtggttggaggatctactggaggtgtttgtaaggaaggcttttacagggtgnatatagaagtaaagtagagaaattatttgattggcaaaaatgtgggcagttgcattatttgaactatcctggtggtaggtctctcattacccagctaatactcngcaggccacctgtgggtgggctaagcttgtttcattttgtctangcaggaaccctggccatgggagctatctcagcctaatgctctcccattacnaaattttacaccttctttctgtatcagggtaagtggggatcttccccaggagggttcttaccaccctgtttccctcagcaaaatgaaactgtcccttttgcctctgtaggcaatcttctgaacaaggcattcctaatattcttatctcatcttattttatcttatcctcttctctgtaccttgtttacatgcttctggaacacttgtgtgtcttgcacccatctcctncattatttaggcaatcctaacagaaggccnctaggatggattggaagagaactgctggcatattgagccctctctctttgtatctggaactttcataattaccttagttctccatgccaattttgcacttatctttgttctccacttcaaaatacatttacctctgacagcagctgagttcataaaagggaacttgtccagtggtacttatgaggcaggagacatgatatagttaaaattataaactataatcactatatagttatatattatatataancactatatcactccagggttgaagtgatactcctgcctcagcctcctgagtagctgggattacaggcatgtgccaccacactcgaataatcgtatatgttttaaaataggaatagattttctcagctaaacggaagggaaatgctaaggaaagagtgagatttnacttgataattatgtttctgaatgaatcagccaattaataaaatgaaaacaggccaggacagtggtgcatgccagtcatcccagcaatttgggaggccaaggtgggcagatcacttgagtccaagagtttgagacaagcctgagcaacatatcaaaaccccntctctacaaaaaatacaaaaattagccaggtgtggtggctcatgcctgtagtccctgctacttgggaggctgaggtaggaggatcacctgagcctggagatgtagaggctgcaatgagctgtgatcatgccactgcacttccagcctgggtgacacagtgagaccctgtcccaaagaaactaaact

SEQ ID NO: 67279 - DNA, 290 bp, Homo sapiens
tgcagctcttgccccatgtgtcacttttatacacaagttcgacaagacccgaaccagccagtaccttctcccaggagacgagcccactcagcctgcattttgatggatcagccgtgtcacattgctgtagaaatttctaaatacttattctttttattttgtttcttatttcacagtggatccacaacagtctctggtgaacagcatgctctgagtagcaccgttctagtctttgtataccagggatgtttcacagtaaatgtttaaatcattttggacatatttatgtt

SEQ ID NO: 67280 - DNA, 462 bp, Homo sapiens
aatgaatatttaagaagtaataaagggaaggcttgaattgtgtgaaccacgaaagcactaaataatctagaattcaggtaggggtttttgattataagcttgcatcaggtctgtttttggcatttcttggaaatgaagtaattcactgcaggcttgtcaagaattggtcttggggccgggcgcggtggctgatgcctctaatcccagcactttgggaggccgaggcaggtggatcacctgaggtcaggagttcgagatcagcccggccaacatggcaaaacctcatctctactaaaaaatacaaaaattagcaggcgtgatggcgtgcacttgtaattccagctacttgggaggctgaagcagaagaattgcttgaactcagaaggcagaagttgcagtgagccaagattgcaccactggactccagcctgggcaacagaatgagactctgtctcaaaaaaa

SEQ ID NO: 67281 - DNA, 2871 bp, Homo sapiens
gggcacctgaggaagcgggctgcgcctgtggcacagtggtacggggccggaagataacttacctgaagaggcgatcaatccctgagaatcgcgggcgacccgttttttgtgtgcccgggtgcggggtgccgggacacggcgttgaaggcgctgagcggagggatctcagggcgagctcgagcggcgacggcgcgctctgtgattgcaccgagagcgcctgaggtgatctcggcctacatcgcgtcagcggggccttgggcgtgagcaccgccccctgtccggacgcagggtactggggcacctcgaactgtggcacctcacccttctccggggccacgtcttggggactccgacagccccaaataagccctcggggactggggttgtgaaaagcgaggtcgtgaagacgccggcctcataccgaagggtaggacggtgaggtcagccccgtcccactccaactaaaatcaacctgacaggaggtggttcaggaaaacggtcccatttggcacctcaagtctaggtccctcaagtctctacaacagtatgcaaagaaaatgttcatcttcattcttcttatagttttctggtaacttactgaaccaagcgcacacacactctccaaggacaaacatttttcagtgctgggacaatgcaaattcagctctcggcagactactacacactgtgcatgatataccaagactaaaagactcataacctacccgcagaaagagtgcatcttccatagtagctctgcaaaaagatccaaaagaaactgttaatggcctggcttaagtcaaattgtgtccggaattggtgggttcttcgtctcactgacttcaagtatgaagccgaccctcacggtcagtgttacagctcttaagatggcgcctctggagtttgttccttctgatgttcggatgtgttcggagtttcttccttctggtgggatcgtggtctcgctggctcaggagtgaagctgcagaccttcgcaacttccttccagaggaagatgttgactctaatgtattctgtctaggatgtgtttcataaatctggttagaagatttcccttccagcatcaacaaattgttttctaaatgtggaaaaagagacattcagtacaggctaacgtaacgtgggacagcatgcaaagccatgagaagtgggaaaatgagagagaatctgggcgtggcttacagggctgctgaagtaagacacacccttcgcttcacctgtggcctcccgcggcggctgcggctccttcgcaggaccggtagggggcgcgcgcggttgagtccagcaattgcgaggacctccgcaggcgcagcccagcactgacgcctctccgggccgtggctcctctttcccaggccgaaagcggccgggccctctgctccgctgcgccctggctcggccgcacccactgcgcgtttgtgagctggccatcggtcacactgggatactcgaggaggaggcctggggcctgcattcaattccctaagagggacccgcgctggccgctgcaggcgggtggagaacgggcgtctgagtctttggctttcgtaccggaatctccccgggagattttacaagcccctccgaatgttctgattgaattggtctgggggggtcggtccgggcatctaacgagcagccgggatggagaattactagtctggattctggtcctcagaggttcactcacgttaatcaacccgagtccatcttggtgggattgtcttgctccgaggccctcccactgagctttattttcctgcctgatttcggggtccgctaacaggatgaacagcggaccatacaggcacagtgaaaatgacacttggtgacgtggaagacccagcttgccacagttgaggcagagctcctcagggtcttttgtcttagttatccccgagctatttttcaggaaccgacaggctcccccaccccaacaccggatgaaggccagcaactggaggccaggaataatcaagcacgctctcatttcaaagaggtgacgattgtgcccgtgtttaaaagggatgcctgagaccatgaggatttggagttttggaggcggatctgcctttggggagtgagcgtagggccctaagatgtggttgtgctttgagacagttcccaaaatacggtatttgtcagaaaacatgtagtatttgtataatttgagaatgtaattgaagaacccgatatagagcttttagaaaggggaaatagaaaacttaaaaagaatcttgcttggtatattaataccaacatctaaaatataataaaattgaataaaccagtgagttttatactatgattgaaataaaatgccactatgttcttaagagtgctagtttaacaggaaatctccaatgcattattatctagactcatctcaaaggctcacttttcatttgcatgggcccttgctatttgtagggtaggaggcagcacctcgttctggtggctgccaccttgatgaggagacactccttgttaacaggatggttagcccacggctcttcccagcccccttttccacacccagtaaattgttttagtttatggccctcagctgcagttgcaatcatcatcaaattccagttttgaatttaaaggtgaataatgaatgcaatgaactttctagaatttatgaagggcagtgatgttcctttttatctaataattctacatgtgtagcctttcagtatgctattctgtggactgaatttacaaattgtcatttgtttaatgaactgttaatataacatgatgactaactgaaaacacatacaatttgctggtattccagaagtctatggatttcgttgttttgtttaaataaaaggcattaaaagc

SEQ ID NO: 67282 - DNA, 319 bp, Homo sapiens
ggttggtgtctgatgctctgttttctagcctctcttcttctgctcctcccctcccccagctgcctaccaactccttcccacccccaggccagcagtgactgcctccaagactccccctccttccagcaccgcctcatggtttccatggcaacagaaaatgttggtgggaagcaaaaatgctgaactgcaactcgtgttggggctgggaggaggaggtgaaatgtgggcctctctggaggctgtagaaaggtggggagaaagaagccaggtgagaagccctgagaagaaaggaccacgaggctcgaaaggaaggtgcatt

SEQ ID NO: 67283 - DNA, 324 bp, Homo sapiens
agggtgtttgctgtattatctcaaactacctgtagtgtatttgtaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaa

SEQ ID NO: 67284 - DNA, 411 bp, Homo sapiens
ttcttgtccttcctctcaaaacacagatcctgtagctttttccagacagcctttactatttccttaccctcagtattaagaatttttcatgtaagatgttctcagaatcttacaagtatccttgtacccatttctttttgaagaacatgacctttattgagcagaaattttttcctacttgcattttttcagactttaaccattattgtctttttagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaa

SEQ ID NO: 67285 - DNA, 2345 bp, Homo sapiens
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaatgtcgtccagaattttcatcagaaatggatagctttaacatctaaaattattatattttgaagcaagaagcactctaagctatttactaataggcttttcatataattaggaaaacctaatatcacatctatagtaaccatttcagtttcatattgtttctgttctcataaggatactgctgagtgtctttgcagattcagcctaaaagcaaagaaaatatttccctaaaatatttgcaaataatgttcacatatgtaaatgccttggaaaatattactcatgctgaccttttacacctttttcatttgtcatactgttttctttgccttgaagaggaacagatgaatatgcaccttctccagagttatgtggttttagaatttagaagagcatgtatctttattaaatccctcctcaactctttttttttaaagcatctgaatttaaccttatttcttttttatctccatggtgtgggtgggaccaccatggttttacaccccaccctaccttagggaagaagaaaacattttaaagaataccagaagtagaatcacatgtaacagtctctgcgctttcctttgtaatttcagggcttaaacactattatcctaatccaagttcacagtcctgttgttgtcgaggagggttcaaaatcatttggagataatcaagctcagacagcttaggataggtgagaagaacatagaggaagcagggagaaggctgagaagcaagcaggagtgagcgctaagtgttttgtttccagttagctgttcgctgtcttttccatttaacctgggcactgccctagcctcatcttcagccttcagtgatctataatagcatttccttctgtctcctctcagtctctcttccgccttccttccctcctttactgtattagcaacaagctgtccatgggtgggggctgtgtgttagcctgtacgtagcacatgggactttccacatagtagatattcagttacattttgaactaattatataacaaacttgccctttgaaagactaagttatagttaaaaaccaagatttgtaggagaaaaagaaattattgttcccttcagtttgaaaaatcatcgatatttgaaactgggatacgcttggtagcttttttgttttaacacaaagtaaacctgtgaagtaga

SEQ ID NO: 67286 - DNA, 2173 bp, Homo sapiens
acttggttcattttgtttcctggtggtttgagaagaaagttcctgtggtgaaattgaaaaggggataaagggaagtacttattttaaaacataagtaacttgtggattgttgaatactggaaaaagagtgttacttccccgttaacctacgcctcgtgtaatccttcaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaatgtcgtccagaattttcatcagaaatggatagctttaacatctaaaattattatattttgaagcaagaagcactctaagctatttactaataggcttttcatataattaggaaaacctaatatcacatctatagtaaccatttcagtttcatattgtttctgttctcataaggatactgctgagtgtctttgcagattcagcctaaaagcaaagaaaatatttccctaaaatatttgcaaataatgttcacatatgtaaatgccttggaaaatattactcatgctgaccttttacacctttttcatttgtcatactgttttctttgccttgaagaggaacagatgaatatgcaccttctccagagttatgtggttttagaatttagaagagcatgtatctttattaaatccctcctcaactctttttttttaaagcatctgaatttaaccttatttcttttttatctccatggtgtgggtgggaccaccatggttttacaccccaccctaccttagggaagaagaaaacattttaaagaataccagaagtagaatcacatgtaacagtctctgcgctttcctttgtaatttcagggcttaaacactattatcctaatccaagttcacagtcctgttgttgtcgaggagggttcaaaatcatttggagataatcaagctcagacagcttaggataggtgagaagaacatagaggaagcagggagaaggctgagaagcaagcaggagtgagcgctaagtgttttgtttccagttagctgttcgctgtcttttccatttaacctgggcactgccctagcctcatcttcagccttcagtgatctataatagcatttccttctgtctcctctcagtctctcttccgccttccttccctcctttactgtattagcaacaagctgtccatgggtgggggctgtgtgttagcctgtacgtagcacatgggactttccacatagtagatattcagttacattttgaactaattatataacaaacttgccctttgaaagactaagttatagttaaaaaccaagatttgtaggagaaaaagaaattattgttcccttcagtttgaaaaatcatcgatatttgaaactgggatacgcttggtagcttttttgttttaacacaaagtaaacctgtgaagtaga

SEQ ID NO: 67287 - DNA, 1273 bp, Homo sapiens
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaagaacaaaagtccagaatgttgacctaattttacaaaacaagctgcatatcagctgatgaatgcatgagaaattttcaaggctttcacagtggtcttaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaa

SEQ ID NO: 67288 - DNA, 1574 bp, Homo sapiens
  misc_feature (1330)..(1330): n is a, c, g, or t
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaagaacaaaagtccagaatgttgacctaattttacaaaacaagctgcatatcagctgatgaatgcatgagaaattttcaaggctttcacagtggtcttaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaaaaaaaaaaaaaaaaaaaactcgagtttttttttttttttttttaaattaataaattnggtaaaatttaagggggggtgtggatgaaaagtggacctaaagggaggggggggaaattaaattgggcgtaggtgacaacgtattgattggaaaaaccctgggtttaaccaagtaaagcggctaaaaactaatccccttttcccctagatggctttaagaaaaagagctttcaccggtcggccttccaaacagatgcgccacctgaatggcggcatgaaaatttggaggcgaaatattttggat

SEQ ID NO: 67289 - DNA, 1329 bp, Homo sapiens
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtgggaaaagctctgattgacaatgtttagtttgtataacacatcttaattgacacaaggacactgatgaaattcaagttaactatcctggaatgtttgaattgatggaagatttacaagaacaaaagtccagaatgttgacctaattttacaaaacaagctgcatatcagctgatgaatgcatgagaaattttcaaggctttcacagtggtcttaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaa

SEQ ID NO: 67290 - DNA, 996 bp, Homo sapiens
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaaggtaaggcactttaaagaatttttagactccattgggaaaggtaggccaaaaaaaaagaatttttagactccatttgagagaaacattttgagagccagc

SEQ ID NO: 67291 - DNA, 1091 bp, Homo sapiens
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaa

SEQ ID NO: 67292 - DNA, 1053 bp, Homo sapiens
acttggttcattttgtttcctggtggtttgagaagaaagttcctgtggtgaaattgaaaaggggataaagggaagtacttattttaaaacataagtaacttgtggattgttgaatactggaaaaagagtgttacttccccgttaacctacgcctcgtgtaatccttcaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtgggaaaagctctgattgacaatgtttagtttgtataacacatcttaattgacacaaggacactgatgaaattcaagttaactatcctggaatgtttgaattgatggaagatttacaagaacaaaagtccagaatgttgacctaattttacaaaacaagctgcatatcagctgatgaatgcatgagaaattttcaaggctttcacagtggtcttaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaa

SEQ ID NO: 67293 - DNA, 2241 bp, Homo sapiens
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaatgtcgtccagaattttcatcagaaatggatagctttaacatctaaaattattatattttgaagcaagaagcactctaagctatttactaataggcttttcatataattaggaaaacctaatatcacatctatagtaaccatttcagtttcatattgtttctgttctcataaggatactgctgagtgtctttgcagattcagcctaaaagcaaagaaaatatttccctaaaatatttgcaaataatgttcacatatgtaaatgccttggaaaatattactcatgctgaccttttacacctttttcatttgtcatactgttttctttgccttgaagaggaacagatgaatatgcaccttctccagagttatgtggttttagaatttagaagagcatgtatctttattaaatccctcctcaactctttttttttaaagcatctgaatttaaccttatttcttttttatctccatggtgtgggtgggaccaccatggttttacaccccaccctaccttagggaagaagaaaacattttaaagaataccagaagtagaatcacatgtaacagtctctgcgctttcctttgtaatttcagggcttaaacactattatcctaatccaagttcacagtcctgttgttgtcgaggagggttcaaaatcatttggagataatcaagctcagacagcttaggataggtgagaagaacatagaggaagcagggagaaggctgagaagcaagcaggagtgagcgctaagtgttttgtttccagttagctgttcgctgtcttttccatttaacctgggcactgccctagcctcatcttcagccttcagtgatctataatagcatttccttctgtctcctctcagtctctcttccgccttccttccctcctttactgtattagcaacaagctgtccatgggtgggggctgtgtgttagcctgtacgtagcacatgggactttccacatagtagatattcagttacattttgaactaattatataacaaacttgccctttgaaagactaagttatagttaaaaaccaagatttgtaggagaaaaagaaattattgttcccttcagtttgaaaaatcatcgatatttgaaactgggatacgcttggtagcttttttgttttaacacaaagtaaacctgtgaagtaga

SEQ ID NO: 67294 - DNA, 1153 bp, Homo sapiens
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaa

SEQ ID NO: 67295 - DNA, 1166 bp, Homo sapiens
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtgggaaaagctctgattgacaatgtttagtttgtataacacatcttaattgacacaagaagcaaggggcatgggcaagcagggcccctgatgttggaaaggagcctccagggagggaagaattaacaggctggaggactaggctgggaactgaagagaaccccggaggcttcacacctgtgactagtgttgatcttttgttaacttttaaatggcctgagtccatagaaactgcatcctgagaggttgctcggctagaaagcggaaaaccgcttcacatgagtgctctactttgtaatgaaaataaacactattaatacaggcaattgtaca

SEQ ID NO: 67296 - DNA, 1175 bp, Homo sapiens
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaa

SEQ ID NO: 67297 - DNA, 4892 bp, Homo sapiens
ggcagctcggccgactgggcccggagcggcgcggaggccgggcgctgacggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggcaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaa

SEQ ID NO: 67298 - DNA, 1985 bp, Homo sapiens
gcgtcgacgtagcagatttagtgatttgaggccccaagtagaggccccatactatttttgtccatacagcatcagatactgtccatgggctacacatactatatgtgtcctctgcctacacaacgatggcagtattattagcaacacttgtctttttactaaataaatgtgtattatatccccttgagtctgagcacgggctgggatttctaagataacatatggaattgtttaatgatggtcataccaaggatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaa

SEQ ID NO: 67299 - DNA, 4917 bp, Homo sapiens
ggcagctcggccgactgggcccggagcggcgcggaggccgggcgctgacggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaaggggtcagggctgtgttttttggcagagcatccgaagggtggatgaggagcacgagcagcaggtggacatgcaggtccttgtctatggcacccgtacgtccaaagacaagagtggagcctacctcttcctgcccgatggcgaggcaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaa

SEQ ID NO: 67300 - DNA, 4737 bp, Homo sapiens
ggcagctcggccgactgggcccggagcggcgcggaggccgggcgctgacggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaaggggtcagggctgtgttttttggcagagcatccgaagggtggatgaggagcacgagcagcaggtggacatgcaggtccttgtctatggcacccgtacgtccaaagacaagagtggagcctacctcttcctgcccgatggcgaggcaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaa

SEQ ID NO: 67301 - DNA, 4204 bp, Homo sapiens
ggcagctcggccgactgggcccggagcggcgcggaggccgggcgctgacggtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaaggggtcagggctgtgttttttggcagagcatccgaagggtggatgaggagcacgagcagcaggtggacatgcaggtccttgtctatggcacccgtacgtccaaagacaagagtggagcctacctcttcctgcccgatggcgaggcaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggtaaggctccctaaggtccgctaga

SEQ ID NO: 67302 - DNA, 218 bp, Homo sapiens
ctcaaatcccgccaaagagcccaagcagtcctggcttttcctctcaaacatcagcctgctcagaaccaaaccagttgtgcacgagcagagaccaaaagaaggctgacttttgattctcttgttctgcttggtccccaccccgagtctggggagtcggttagagcactaggctgagggaggtgtgtttgaagtgggaaccaattgtcagttgattgagt

SEQ ID NO: 67303 - DNA, 423 bp, Homo sapiens
gaaaggaacagaagaaaattcttcataagttcctcatactataaaagacaacaatgtaagtactaatttgacaatattctttttttagatttatatatatatttttttaattatactttaagctctgggatacatgtgcagaacgtgcagctttgttacctaggtatacacatgccatggtggtttgctgcacccatcaacccatcgtctacattaagtatttctcctaatgctatccctcacctatcccctcactccctgacaggccccactgtgtgatgttccccttcctgtgtccacgtgttctcactgttccactcccatttatgaatgagaacatgcggtgtttggttttctgttcctgtgttagtttgctgagaatgatggtttccagcttcatctatgtccctgcaagggtcatga

SEQ ID NO: 67304 - DNA, 874 bp, Homo sapiens
tgtacaagaacttagtttgcctatctgagcaaattttacattcactagtgaatgcccatgtgaaagacaagcaggaaacttccaggggccaaggggcttagaaccaactgaactggtacaaaataaacattaggtatttcagtacgtagagtttgtggacaaaaagaataggctcttaccaattactatgctactagaatatccaattttgcttttaccaagccttagtgaaaagtgaatgaattctaacaagaagactcaaagacactggtgctccccctgtgtctcccttcacttattctgcatggtcagcacctcttcaaaagaccaataataatggtcccctacaagaagtatacaattgctcctctgatgtgaaagcatatgaagaaaataagtgtccaaagctgcataaatatttgcacccctttgagagtatgagaaagtgtgtgttttatgttgtgattgataggacaactttcatggcccactttgaactcttagcaggaactttggaatgtcctgagggtctgtctgcctttgtatggcaggaactctgttttcttagaaaatagtaaagaacagtttgtactcctttgttctaaagggtacctatagtttatgggaattggggaacttagtagaaaaatcaccaacgctctcatgtttctcataaaaaatgctcagctttatttggaaactttggccattgttttctttttcttctttcttcttctccttcctcttttgagttaaaaaggccacagtctgacctacttatatgtgtgatgaaatgtgcagactctgccaaggctatttattctaatgatttatctactcaagataaaaagaaataaagtgaagacaaatctga

SEQ ID NO: 67305 - DNA, 649 bp, Homo sapiens
gatcaattgcagggacctattggactatggggaaaatgagatggttctactcctgtattttaaagtcttccttttccttttggtttctttagtttgtagttaaggctttgcagacttgcatcccataatgtcttcttttctttcattttttttattttttgagacagagtctcactttgtcacccaggctggagtacagtggtgcgatcatagctcactgcagccttgaactcctggactcaagcagtcctcccacctcagcctcctgaatagctgaatacaggcatgcgctaccatacctggctaattattattattgtttttgtagaaatggggtcttgctctatagcccaggctggtcttgaactcctgggctcaagccatcctcctgccctggcctcccaaagtgctgggattataggcatgagccacggtgcccagcctttgtcttagtttttggtccccctcacccgaccccagagttctagaaccattcccttgcaaagaaagggactgctcacggctggggatggagaagtgctgtggtaggagccctttcttctctttcttccccagctggatcgccaaacctaccctgcggtcgtcgtcttcctggccccatagctcctcctcaccaagcatgtcttcc

SEQ ID NO: 67306 - DNA, 450 bp, Homo sapiens
acatctgtgcatcactgctcccttgctctctaagtgagaaaattcagaaagaagctgaaaacaaggtctacaaaatagcaagaattaaaggtaactctgatgtagataacgttatcttggcagggcacagtggctcatgcctgtaatcccagtactttgggaggcgaaggcaggcagatcgcttgaccccaggagtttgagaccagcctgggcaaaacagcaaaacctcgtctctgtctctctctctctctctctctctctctctatatatatatatatatatgcacaaaaattaacctggtgtggtggcgcacacctgtagccccagctacttgggaggctaaggtgggaggatggcttaagcccaggaggcagaggctgcaggcagctgagatcatgccactgcactccagcctgggtgacagagccagatcctgtcccaaaaacaaa

SEQ ID NO: 67307 - DNA, 347 bp, Homo sapiens
ttcttgagttattaagatttttgtgtttttgaaaagagagtctcaccaaattgcccagactagacttgaactcctgagctcaactgatcctccggcctcagcctcctgggtagctgggactataagctcataccaccatgcctggctgtagagttttttttttgttttgtttctaatcattcaagccagacattttcatgggtgccatattaaaatatttcatatttagataatgtaataaaaatacagtacagtaaacagcattatactatgcattattcggtttctgaagtttagctaaaggagacaactaagttcaggagactgtcagctgactgacctctgaa

SEQ ID NO: 67308 - DNA, 319 bp, Homo sapiens
ggtactagaaggagtgtggaagcatgcctctgggttcacaggggttgcaatcccaaatgtctgcagaggctggaaacacaacttacgtggaagccaggcatggtggtgtgcgcctgtagtcctagctacttgggaggctgaggcagaaggattatttgagcctgggaggttgaggctgcagtgagttatgatggtaccacagcactccagcctgggtgacagagagagatcctgtctctaaaaaaataataataataaattcaaatgaataataaaaataatgagaagaagataatgtacatgggtacctatggtacca

SEQ ID NO: 67309 - DNA, 823 bp, Homo sapiens
cacgcagagaagggattggaaacagtagcccggagaggaggctctcttggtaggatcccacggcaaccgaatggatgcacgttgtttatgacgttcttacccatgaaagcgctcaaggatccgcttgcttgcttacatgtgggatcagcactaccttccgtgctgccgaacatcttcttaagcgagggaaagaacaaaaagaaaagttggcaagaaagaaagggcaaagacagagagactgggagagaaagaggccccaatttcctctctctggtagttgctgaattggctctcgtgaaggcagaaagggaagggctgacttatgtccctctgccaggagaggggaaaggagggaggcatgatattgacttaaacgtgggggatttaaaaggcccctatgttcccactttgtgctttgcttctaacagacagcctgggacctttgaagtcggtctggcccagtggggagcgggcttctgtggagacaagatgctaacgggggcgggggaagggggccagggggcggccgaaactctattaggcatgctctagcaaaaagaaaggcaaatccaatgataatgtacatctgtttcagggaatttataagctttgaacattttttatgggcagataagtgggtccttttcttaccataacttagaacttcaaagctgagtgtgtggataatgcaaattgctgaaatatgagattttccctacaaagaggtttccaaaaaagacgaggaagaaaaagaggggggggggagagagaacgaaggctaactgatgccacagtcttttatgtacatggcaaaaacgggaca

SEQ ID NO: 67310 - DNA, 479 bp, Homo sapiens
agccaggtgttttctttcagaggcacacacaatgtaccagtctctaaacacctgcaacagccctcctaacgcccactgggaagtggggaaaggtgtggcacagtgactgacctttagccagctccctccttctaggaatcaggtgccatgctggggacgatcctatgtgtagactccattttatagagatgggaagtcagaaaatgctagaatcaagacttaaaactcagctttttgattctcaagttcatgagagcagacattatttcattaattcactccatacatatttattaaaggagtctcaatggataatctgagttggcttcagggtggtttatgaagcagagaagtaaaatgctttactaagtcacatggctagagaatgcatttaacttgcattatacatttagacacctttctctggtaggactgactcagagcccatttaaaataaattcaaggccgggtgtggtagc

SEQ ID NO: 67311 - DNA, 510 bp, Homo sapiens
tataaatatcattatgcttttgcttaactggggcaaaaatcatgtgcattatttcagtgtctgcttttaaaagtagatggtagtattttattttcagttaggtgaagcagaaaaatgtatccagcaaagtcttcattaaaaagcttaagatggctagaactaaatatacattgaacacaattactaatttatcaaatatgtttgcatgttggtcagtatatacaataaaaaatagtgtttaatttgaaatgttaaaaccctctctaggtccaaaaaatagaatggatgagacctactatttgatagcacagcagggtgactttagtcagtaataactatacatttaaaaataacttaaaagagtgtcattggattgtttgtaacccaatggataaatgagaggatggagaccttattctccacagtgtgctgctttcacattgcatgcctgtatcaaaacatctcatgtgcctcataaatatatacacctactatgtactcaaaaaatta

SEQ ID NO: 67312 - DNA, 496 bp, Homo sapiens
acccacatcattttataaacaaaaaatggtcattcagagaaaaggttccttcagtgtctctgctgctgttccttagtgagaaaatgacttctaaaagggaggcaaagaggcatgagaggcaagtctactgaagcaggactggtttcacttctggcaccaaagtcgatggcaacaatgacggatctggagacatgccttatgataaataccaaaaggcagcgacatcgtaggcatggcagctacaggcactgcagaccaagaagcagagcttcaagccccacactcacaaggctaaaacgtttcctcgtgtgagaaacagaaccaccactaacaatttttggaaataatatttgagtcttggctcccaactggataattttgttctgcaccaaaagcaattccattcaaattcccaaagtcttcaagcggcttcagactaatttcaagacacagtttccttccaagcccaatgaaatgaaaggcagaaaccaacaaa

SEQ ID NO: 67313 - DNA, 4123 bp, Homo sapiens
gcggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactggagacagcgagaaccttcgggctggcatcgtggcaggcaacagctccgagtgtgggcagcagccggtcgtggagaaatgcgagacaatccacgttgctattgtctgcgctggatacaatgccagccgggatgtcgtcaccctggtcaaatccgtcctgttccatagacggaaccctctgcacttccaccttattgctgactccattgcggagcagatcctggccacgctcttccagacctggatggtgcccgctgtgcgtgtggacttctacaatgcagacgagctcaagtctgaagtttcctggatccccaataaacattactctgggatttatggtctgatgaagcttgtcctgaccaagactcttcctgccaacctggagagagtcatcgtccttgacacggatatcacctttgccactgacattgcagagctgtgggctgtgttccacaagttcaaaggtcagcaagtcctgggcttggtggagaaccagagtgactggtaccttggaaacctgtggaaaaatcaccgcccatggccagcccttggaagaggctacaacacaggggtgatcctgttacttctggataagctgcggaagatgaaatgggagcagatgtggaggctgaccgcagagagggagctcatgggcatgctctctacatccttagctgaccaggatattttcaatgccgtcatcaaacaaaaccccttccttgtgtaccagctcccctgcttctggaatgtgcagctgtcagaccacacccgctccgagcagtgctacagagacgtgtctgatctaaaggtcattcactggaactcccccaagaagctccgggtgaagaacaagcatgtggagttttttcgcaacctctacctgaccttcctggagtatgacggcaatcttctgaggcgggaactgtttggctgccccagtgaggctgatgtcaacagtgaaaacctccagaagcagctgtctgagctggacgaggacgacctgtgctatgagttccggcgagagcgcttcactgtccaccgcacccacctgtacttcctgcactacgagtatgagcctgcagcagacagcacggacgtcaccctggtcgctcagctgtccatggacaggctccagatgctggaggccatctgcaagcactgggaggggcccatcagcctggccctctacctgtcagacgccgaggcccagcagttcctccgctacgcacagggctctgaggtgcttatgagccgccacaacgtgggctaccacatcgtgtacaaggagggccagttctaccccgtgaacctgctgcgcaacgtggccatgaagcacatcagcactccctacatgttcctgtctgacattgacttcctgcccatgtatgggctctatgagtacctcaggaagtctgtcatccagctcgatcttgccaacaccaagaaagcaatgattgtccccgcgttcgagacactgcgctaccggctgtccttccccaagtcaaaagcggagttgctgtcaatgctggacatggggaccctcttcacattcaggtaccacgtctggacgaaaggccacgcacccacaaacttcgccaagtggcggaccgccaccacgccttaccgggttgagtgggaggccgattttgagccgtatgttgttgtgagacgtgactgcccggagtacgaccggaggtttgtaggctttggctggaacaaagtggctcatatcatggagctggatgtgcaggagtatgagttcattgtgctgcccaacgcctacatgatccacatgcctcatgcccccagcttcgacattaccaagttccgttccaacaagcaataccgcatctgtctcaaaaccctcaaggaagagtttcagcaggacatgtcccgccgctacggctttgctgccctgaaatatctcacagccgagaacaacagctagcaccaagaagcccaccactagggggagacatgctgtaggggaagtgccactcgctgtttggggcccggccttcaaattcaaaattgagccatgctttttcggtttgtttttatttatctctttggcccagccaagctgccctcactacagagaccttggacaaggatccagccagtccctctctgccccacaaccctgcattcccagaggttagctatgcagcccacctagatgagtctcttcaagaatgggaaatcaaggggtgacagggagtaaaagggttatcatcttactgcaaagccacaagatcagggcagggctttaggatgttctggatgctttttaataattatgcttcccatcataactggggagaaagggaagtcagggttctaggggttattcgtcccaggaaatagaagtgaaattgtctttattaagtgaaaactttcccctttgccctgcaatgtagctgggcattcaaacggagggcaaaccgatgatctaaaccaaccacttggaaaaacccaatggggacattgtaaccagagggtcctggaggtggggttgatgggtttccttatccccaaagtcactcctgttttgttttgtttttctttgggggttttgtttatttttggggctggcaatccaaaatagaaaatctgatcctttgaggctctaaaggaaaatcagctgcctctaccaaccaccctctatcagcagtggcccaggaaggaggtcaagcatcttcggccgatatttaaacatgggcagcttccttcaggatgatcaccgaggctcccgtgactttgaactccctactctccagaatccaggggctatagcgatggggactgcggaattacgagggctggctgttttacaccggtcacattttctattggcagtgactgattcatgggaaagggctttgaaggaactacttcagtgcacacacaaggtacgaacctctcaggcctttcgaagaactttcataattcatgaaagcccagttctgaagattcacgtatccatctggagacctacaggaagaaagtgattgggttcctctggttcttgcctgcttcactgtggatgggaagaggtgacaacctcagtctccctttgggacctgtccaagggtaggcaaccaccttcaccttcacacagattgaggagacactggactttttacccattttctttaatcttcaatattaatattgtgtttacattgatgagaacaagagttaatgccctaccctctgctgggctgtttgtattgagttgcaatgtgaccagcgaaagctgcatttaataaatgaaagtacagactgtt

SEQ ID NO: 67314 - DNA, 1069 bp, Homo sapiens
gctaggggttattccgtcccaggaaccctgacttccctttctccccagttatgatgggaagcataattattaaaaagcatccagaacatcataactggggagaaagggaagtcagggttctaggggttattcgtcccaggaaatagaagtgaaattgtctttattaagtgaaaactttcccctttgccctgcaatgtagctgggcattcaaacggagggcaaaccgatgatctaaaccaaccacttggaaaaacccaatggggacattgtaaccagagggtcctggaggtggggttgatgggtttccttatccccaaagtcactcctgttttgttttgtttttctttgggggttttgtttatttttggggctggcaatccaaaatagaaaatctgatcctttgaggctctaaaggaaaatcagctgcctctaccaaccaccctctatcagcagtggcccaggaaggaggtcaagcatcttcggccgatatttaaacatgggcagcttccttcaggatgatcaccgaggctcccgtgactttgaactccctactctccagaatccaggggctatagcgatggggactgcggaattacgagggctggctgttttacaccggtcacattttctattggcagtgactgattcatgggaaagggctttgaaggaactacttcagtgcacacacaaggtacgaacctctcaggcctttcgaagaactttcataattcatgaaagcccagttctgaagattcacgtatccatctggagacctacaggaagaaagtgattgggttcctctggttcttgcctgcttcactgtggatgggaagaggtgacaacctcagtctccctttgggacctgtccaagggtaggcaaccaccttcaccttcacacagattgaggagacactggactttttacccattttctttaatcttcaatattaatattgtgtttacattgatgagaacaagagttaatgccctaccctctgctgggctgtttgtattgagttgcaatgtgaccagcgaaagctgcatttaataaatgaaagtacagactgtt

SEQ ID NO: 67315 - DNA, 1328 bp, Homo sapiens
gcggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactggagacagcgagaaccttcgggctggcatcgtggcaggcaacagctccgagtgtgggcagcagccggtcgtggagaaatgcgagacaatccacgttgctattgtctgcgctggatacaatgccagccgggatgtcgtcaccctggtcaaatccgtcctgttccatagacggaaccctctgcacttccaccttattgctgactccattgcggagcagatcctggccacgctcttccagacctggatggtgcccgctgtgcgtgtggacttctacaatgcagacgagctcaaggtatgggcaggaggggaggcacttccgtgatctcctctagctggaagcgttattacttgtggttgagcagactgtagcaatgccagaaatctcagctcctaactgaaaatgtgtagggcgtaaggaagttgtttgccagcagaatctgattttattatcgaagtattaaagtaacccctttgagtgcacaaaatccactttgg

SEQ ID NO: 67316 - DNA, 474 bp, Homo sapiens
cggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaaggtaagagccccggagcgcgagagtcgccgcgggggcgccgtggtgtg

SEQ ID NO: 67317 - DNA, 4410 bp, Homo sapiens
gcggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaagaacctacattaagaaacgcattcagatgcatcagccgtttgtaaagcacctgtcgtgagccagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactggagacagcgagaaccttcgggctggcatcgtggcaggcaacagctccgagtgtgggcagcagccggtcgtggagaaatgcgagacaatccacgttgctattgtctgcgctggatacaatgccagccgggatgtcgtcaccctggtcaaatccgtcctgttccatagacggaaccctctgcacttccaccttattgctgactccattgcggagcagatcctggccacgctcttccagacctggatggtgcccgctgtgcgtgtggacttctacaatgcagacgagctcaagtctgaagtttcctggatccccaataaacattactctgggatttatggtctgatgaagcttgtcctgaccaagactcttcctgccaacctggagagagtcatcgtccttgacacggatatcacctttgccactgacattgcagagctgtgggctgtgttccacaagttcaaaggtcagcaagtcctgggcttggtggagaaccagagtgactggtaccttggaaacctgtggaaaaatcaccgcccatggccagcccttggaagaggctacaacacaggggtgatcctgttacttctggataagctgcggaagatgaaatgggagcagatgtggaggctgaccgcagagagggagctcatgggcatgctctctacatccttagctgaccaggatattttcaatgccgtcatcaaacaaaaccccttccttgtgtaccagctcccctgcttctggaatgtgcagctgtcagaccacacccgctccgagcagtgctacagagacgtgtctgatctaaaggtcattcactggaactcccccaagaagctccgggtgaagaacaagcatgtggagttttttcgcaacctctacctgaccttcctggagtatgacggcaatcttctgaggcgggaactgtttggctgccccagtgaggctgatgtcaacagtgaaaacctccagaagcagctgtctgagctggacgaggacgacctgtgctatgagttccggcgagagcgcttcactgtccaccgcacccacctgtacttcctgcactacgagtatgagcctgcagcagacagcacggacgtcaccctggtcgctcagctgtccatggacaggctccagatgctggaggccatctgcaagcactgggaggggcccatcagcctggccctctacctgtcagacgccgaggcccagcagttcctccgctacgcacagggctctgaggtgcttatgagccgccacaacgtgggctaccacatcgtgtacaaggagggccagttctaccccgtgaacctgctgcgcaacgtggccatgaagcacatcagcactccctacatgttcctgtctgacattgacttcctgcccatgtatgggctctatgagtacctcaggaagtctgtcatccagctcgatcttgccaacaccaagaaagcaatgattgtccccgcgttcgagacactgcgctaccggctgtccttccccaagtcaaaagcggagttgctgtcaatgctggacatggggaccctcttcacattcaggtaccacgtctggacgaaaggccacgcacccacaaacttcgccaagtggcggaccgccaccacgccttaccgggttgagtgggaggccgattttgagccgtatgttgttgtgagacgtgactgcccggagtacgaccggaggtttgtaggctttggctggaacaaagtggctcatatcatggagctggatgtgcaggagtatgagttcattgtgctgcccaacgcctacatgatccacatgcctcatgcccccagcttcgacattaccaagttccgttccaacaagcaataccgcatctgtctcaaaaccctcaaggaagagtttcagcaggacatgtcccgccgctacggctttgctgccctgaaatatctcacagccgagaacaacagctagcaccaagaagcccaccactagggggagacatgctgtaggggaagtgccactcgctgtttggggcccggccttcaaattcaaaattgagccatgctttttcggtttgtttttatttatctctttggcccagccaagctgccctcactacagagaccttggacaaggatccagccagtccctctctgccccacaaccctgcattcccagaggttagctatgcagcccacctagatgagtctcttcaagaatgggaaatcaaggggtgacagggagtaaaagggttatcatcttactgcaaagccacaagatcagggcagggctttaggatgttctggatgctttttaataattatgcttcccatcataactggggagaaagggaagtcagggttctaggggttattcgtcccaggaaatagaagtgaaattgtctttattaagtgaaaactttcccctttgccctgcaatgtagctgggcattcaaacggagggcaaaccgatgatctaaaccaaccacttggaaaaacccaatggggacattgtaaccagagggtcctggaggtggggttgatgggtttccttatccccaaagtcactcctgttttgttttgtttttctttgggggttttgtttatttttggggctggcaatccaaaatagaaaatctgatcctttgaggctctaaaggaaaatcagctgcctctaccaaccaccctctatcagcagtggcccaggaaggaggtcaagcatcttcggccgatatttaaacatgggcagcttccttcaggatgatcaccgaggctcccgtgactttgaactccctactctccagaatccaggggctatagcgatggggactgcggaattacgagggctggctgttttacaccggtcacattttctattggcagtgactgattcatgggaaagggctttgaaggaactacttcagtgcacacacaaggtacgaacctctcaggcctttcgaagaactttcataattcatgaaagcccagttctgaagattcacgtatccatctggagacctacaggaagaaagtgattgggttcctctggttcttgcctgcttcactgtggatgggaagaggtgacaacctcagtctccctttgggacctgtccaagggtaggcaaccaccttcaccttcacacagattgaggagacactggactttttacccattttctttaatcttcaatattaatattgtgtttacattgatgagaacaagagttaatgccctaccctctgctgggctgtttgtattgagttgcaatgtgaccagcgaaagctgcatttaataaatgaaagtacagactgtttcttccccattcccctcccactcttgcaggaagctactgagacacaccttgacatagagagctaaattgcagtggataaacagcaacttcacactttctgttcccccattctatttttctcatcatttgaactttagccttttttttccccttttgcctgaagttagatcccactctgtctctaactcaaaccatcttcaagttttccattccgcatctttctc

SEQ ID NO: 67318 - DNA, 1654 bp, Homo sapiens
gcggccgcgctcgtctcgccgggctgttcgcgggcaggccctgccctgaagggacgaatcggcttggagcgcgggaggtggagtcggccccggcggtcgctccctggacccaacccgaggctgacccaggcccctgcccatgcggggcgcccctggctcggaagagtcccccgggccgggagcagctccaggcagcggccccggaggaagaggaagaagggacagtgctcagcttgggggacccggaccctcgccgcggcatttggagccgggggcagtcccgaactctgtgcttggcaccgccgctccgagtagggcagcgcctgccgggaccctgacccggaccccctgcgcctcgtaggcggcggcgccgccgcgccaccctgttcttccgtgtctccctctgcctggcggcagtcacggccaagagagtattatgagggaggccgaggacttcatgctccggacagagaaacggcgctgggattagggattgccacttctgagaggatgctgggaatctgcagggggagacggaaattcttggctgcctcgttgagtcttctctgcatcccagccatcacctggatttacctgttttctgggagcttcgaagatggaaagcccgtgtctctgtcaccgctggagtcccaggcacacagccccaggtacacggcctccagccagcgggagcgcgagagcctggaggtgcgcatgcgcgaggtggaggaggagaaccgcgccctccgcaggcagctcagcctggcccagggccgagccccatcccatcgccgaggcaaccactccaagacctactccatggaggagggcactggagacagcgagaaccttcgggctggcatcgtggcaggcaacagctccgagtgtgggcagcagccggtcgtggagaaatgcgagacaatccacgttgctattgtctgcgctggatacaatgccagccgggatgtcgtcaccctggtcaaatccgtcctgttccatagacggaaccctctgcacttccaccttattgctgactccattgcggagcagatcctggccacgctcttccagacctggatggtgcccgctgtgcgtgtggacttctacaatgcagacgagctcaagtctgaagtttcctggatccccaataaacattactctgggatttatggtctgatgaagcttgtcctgaccaagactcttcctgccaacctggagagagtcatcgtccttgacacggatatcacctttgccactgacattgcagagctgtgggctgtgttccacaagttcaaagatgagaatggtggtcgtatgtactagactcccacattttcctttgggaataaaggccttattacgccagctggtgggagcagtccctgcagcgggggctctcagaaaaggcatcagccctttttgcagttgcctctgttgaagtgagtggccatgcctgtggccacaccccttcgtgggacaccccacatcacggaatggctgatgaacatgaggtcctgcaggatcatctgccacactcggatactgcctcacaggctgattttcccctctgcctagtcctgctttctccccttccctttcataggtactgttctcaagagctctctctaataaacctcttgtatgctgacatcca

SEQ ID NO: 67319 - DNA, 1536 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67320 - DNA, 111 bp, Homo sapiens
tagatcgagctggtaccgtacatgatcatccggcctctccagcctcagccccctgcttcagtcccttccccatgcttccttgcctgatgacaataaagcttgttgactcag

SEQ ID NO: 67321 - DNA, 962 bp, Homo sapiens
gctgagctcaagctgggatctggcgggtgggtggggaggtagggagctccctcagaataaaggcagagggtaaagaccttgggagtccccacgtctccctcaagaagtcaggaactagcatcaagagccaggctacatgttctggcttgttctcaagtttccggtctgtgcctcccacacgctgggattaaccataaaaagttaacatttcaaatggcatgtttctgggctttgggatgtgggaagctggtgagaaggcacactctctccacagttagatttgggaggaggcctgacttgggagagggatccaggctcacaccgccctgtcctgtgtcctgtctgcagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67322 - DNA, 742 bp, Homo sapiens
ctcggttgtgttgaagtcccctggacagtgggcaggggtggcagaggacacgagcagccactgcccgtaccccctctcctctctgtaagcccatgccctgtcttcccaggacttgtgagcctcttccctcgacggtcctcttctctcccggcctctccagcctcagccccctgcttcagtcccttccccatgcttccttgcctgatgacaataaagcttgttgactcagaaaaaaaaaaaaaaaaaaaaaaaaaaaaaaaaaaaaaaaaaaaaaaaaaaaaaaaagacagaaaaaaaaaaacaaaaaaaaaaaagaaagaagcgaaaagaacacagagcgcgacgaacggccactcaccctgcacgcacgcacagaacagccgggcggcaggccgccctccacgcgcggcgcgcccgaggggcgcgcccacgccacgagggaggagtgggccgcggagaggatgcaggcaggcggagggcgaggcgccaagccgcgtcggcggcccgccaaccgccgcccgctgccgacgagccgcgcacacgcggccgccacgcccccccgatcgctgactcgcgtagacgaaacagcgatgtgttctctcctggcacgcgagtcacagcggtggcgatagctcgccgtcgctctagtagataggagatcacatgcggcgacagaggaacgcaggaggggaggagcgggaaacatccgccctggaccagaggcctgttatctggcagcgct

SEQ ID NO: 67323 - DNA, 327 bp, Homo sapiens
  misc_feature (2)..(2): n is a, c, g, or t
  misc_feature (32)..(32): n is a, c, g, or t
  misc_feature (35)..(35): n is a, c, g, or t
  misc_feature (38)..(38): n is a, c, g, or t
gntgcagggaattgggacgaggcaccgtaccngcngcntgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67324 - DNA, 607 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (17)..(17): n is a, c, g, or t
  misc_feature (20)..(20): n is a, c, g, or t
  misc_feature (570)..(570): n is a, c, g, or t
  misc_feature (590)..(590): n is a, c, g, or t
  misc_feature (600)..(600): n is a, c, g, or t
ngntntcgaattcgagntcngtaccccaacgcatgtccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaaaaaaaagaacctgaccccgaggnggcccccaccattaacttgngccaaaaggnaaaaata

SEQ ID NO: 67325 - DNA, 1024 bp, Homo sapiens
  misc_feature (23)..(23): n is a, c, g, or t
  misc_feature (62)..(62): n is a, c, g, or t
  misc_feature (882)..(883): n is a, c, g, or t
  misc_feature (897)..(897): n is a, c, g, or t
  misc_feature (905)..(905): n is a, c, g, or t
ggcaaaggctgggatacccgggnccccccccgatgtttggatatcgtcgacccacgcgctcngctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtggnnaaaaccgaggtgcncgatggtntcccaaaacagggactaacgcgggggcccccctcggcggcgccgggaaaggaaactggccggccacgggctggagaaggccccaaaacgggaccgggagaccactggccccacagcgga

SEQ ID NO: 67326 - DNA, 1543 bp, Homo sapiens
taggctaggtgagcctgctgtgattcggcgaggcaattggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67327 - DNA, 1646 bp, Homo sapiens
cagccacctgggagctggcaggtggccagtggtgatgaaagcccagggaatggaaacagaggagcaagcctgttgtaatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67328 - DNA, 2129 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagaaaaaaaaaaaaaaaaaaaaaaaaaaaaaaaaaaaaaaaaaaaacagagagcgggcgcgcgcgcgtcctgctagaagatattatcctctctcgcgaggggggcccccagcttcttgagcgccgtctaccccgatttttttgttgttacccaagagtggttcctcctatgaaggaggagacggcccctattataataaccgcctagcagcagctgggacccgcgcggtttttaacaaaagctcgtccggtagacgcggggcaaaacaagcgcggcagcggtgcggagacaacctgtggggggaagaggacacccctaataatccggcgggggggggggcccactaccatcgtgggcgcacacacatctccccctccaacagagatatttaagaagccttctatagggggaaaaaatttttaaaactttttacgacgggtttttatgggggttgtctacaccatcgaggtggcaattattgccgctgcggccgggtattggcagagactttttggctctatcacaggggattattagtttttttgaaagccattttttttacccgcgggggcgtgtgtatgttgtattaagggac

SEQ ID NO: 67329 - DNA, 2049 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagaaaaaaaaaaaaaaaaaaaaaaaaaaaaaaaaaaaaaaaaaaaaaaaaaaaaaaaagacagaaaaaaaaaaacaaaaaaaaaaaagaaagaagcgaaaagaacacagagcgcgacgaacggccactcaccctgcacgcacgcacagaacagccgggcggcaggccgccctccacgcgcggcgcgcccgaggggcgcgcccacgccacgagggaggagtgggccgcggagaggatgcaggcaggcggagggcgaggcgccaagccgcgtcggcggcccgccaaccgccgcccgctgccgacgagccgcgcacacgcggccgccacgcccccccgatcgctgactcgcgtagacgaaacagcgatgtgttctctcctggcacgcgagtcacagcggtggcgatagctcgccgtcgctctagtagataggagatcacatgcggcgacagaggaacgcaggaggggaggagcgggaaacatccgccctggaccagaggcctgttatctggcagcgct

SEQ ID NO: 67330 - DNA, 1796 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagaaaaaaaaaaataaaacagtaaatcaaacacaaagaagaggcgggggcgcggcgctaaaaaaatattcccgcccagagggcgcaagagtgtcgtgggacccccaggtttttttgtcacaaagtgggcgcccataaggagagcgggtagtataagcgagaggacgagcgcgcgtataaacaccgcttggattcggggaacactgatcgtgggattctgggaagggaccttacttctggcggtgacgatttgggacactact

SEQ ID NO: 67331 - DNA, 1533 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgacccgaagcgccacccgatgcgccccccaacgag

SEQ ID NO: 67332 - DNA, 1487 bp, Homo sapiens
  misc_feature (1)..(1): n is a, c, g, or t
  misc_feature (1477)..(1477): n is a, c, g, or t
  misc_feature (1479)..(1479): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctagtagccacagggacctcaagancnaccaccaa

SEQ ID NO: 67333 - DNA, 1439 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctacccctttgccgaacccgggatcctcaagatcactacaccaa

SEQ ID NO: 67334 - DNA, 1407 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccttccaccttccgccttctgccttccaccttgcca

SEQ ID NO: 67335 - DNA, 2383 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaacgtaagtatctgcgtggcttcggccctgggggttgggtgcatgggacaggcagcccacctgcacgttgctggggcagggtccccaggagctccaggagttgatggctgtccctcagcagggagaagtgactcattagcactgaggattgatactcaggaaaagatcaaatgagagagacactgtctggtctgatgggggtggggcagggaactggtccttaccttggagatcctagtctgatggaggagacaggtcccagctctggagattgtcatctgatgggaagataggaacatggtctcatgatctttgctcttgacagcttttggatgagcaaaaacagtcctgtctctggggtctgtagcctgatgggagatagggacatggtccttgtcctccaaattccaatctgatggagaatatatgatcctagccttagggttcctagtctaatggaggagataggggcctggtttttgtcttggcgatcccagtctgatgggggagatggtagaaaatctatgtcctagagactgcagagaaatggagacggatttcatggagtctacatggctcctccctggcaggacacactggatcagaatcaaataacccatctggggaggcaagactcacacagggccaccggcagagggatgggatggaagggaggtggtggcagggacaggagggatgtgtgtgcagtgtgatgtcgaggtgccagtggaggcactcacagcacctgggggaggatgagggagagagccggctcctgtccatgagggctagggggcaagcgagggcctcctggcccctacccactttaaattgcctgcttctcctgcagcggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67336 - DNA, 1497 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgccccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67337 - DNA, 1559 bp, Homo sapiens
  misc_feature (1)..(1): n is a, c, g, or t
  misc_feature (1491)..(1491): n is a, c, g, or t
  misc_feature (1534)..(1534): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcagtccttggagatagagctgcagtcccagctcagcatgaaagncatcctggagggcaacctggcggagacagagaaccgctactgngtgcagctgtcccagtgctcagggg

SEQ ID NO: 67338 - DNA, 1358 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcgttggccaacgctctcacatgtggcccaagaatcaagataacccgcatgaactcaacattttctctcagccagtaagctttgatacttgcctttctggtggcaaaaccaatggctggatttggcctcaatgaaacctacaaggtttctaaaaccagtgtggagagaatggggccttgaatatgggagaaaagaactgtgagcagcgttg

SEQ ID NO: 67339 - DNA, 2145 bp, Homo sapiens
taggctaggtgagcctgctgtgattcggcgaggcaattggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggagggtgaggtggctggggcagaaggtcaaagatgctgaggagtgggtggcagagccctggggctgggcaatggctgaggccgtgggagagagcagagcaggtgcaccgggattagtcaccttagagggcttccctgtctgcagagccctgatccttggggtccagtgtgcagggcagactcctctttgtaccacactgcttctctgtacacaaggaacctcccaggggcctgcagaggctccctctacctaccctgcctccctcatgagggtgggggataagtaaggaaatcttgtcccatttcaaactctcaaagctgaacatctacatagaagcttggaaattagaggggaacttttgggggcataggcctaataattagattttattttggagagtccttggtctaatgggggagatagagtctgatggtggaggcaatactgagcagaatgaataaaaatcatttagagggtcagatagagcagagggagaacaaaggaggggtccttgtgggaagtggggtccccatgtgggggaaggcttgggagtgagaggtcaggatgggtccagatgcgcacatccacatcccctttttccataggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67340 - DNA, 1507 bp, Homo sapiens
taggctaggtgagcctgctgtgattcggcgaggcaattggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67341 - DNA, 1281 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgccgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67342 - DNA, 974 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcaaggaggctcacagtgctaggaggctccagtgct

SEQ ID NO: 67343 - DNA, 1171 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67344 - DNA, 1178 bp, Homo sapiens
taggctaggtgagcctgctgtgattcggcgaggcaattggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67345 - DNA, 927 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgccgtctggagatggggaaccgaggtgcgggtggttcagaaagggaggacggggggccagggtggggg

SEQ ID NO: 67346 - DNA, 435 bp, Homo sapiens
gaagcctcccggtacccccgagcttgagggagggagcttgaccccaacccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67347 - DNA, 1054 bp, Homo sapiens
taggctaggtgagcctgctgtgattcggcgaggcaattggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattggagatgaacgccctgcgaggccaggtgggtggtgagatcaatgtggagatggacgctgccccaggcgtggacctgagccgcatcctcaacgagatgcgtgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggcccggcctctccagcctcagccccctgcttcagtcccttccccatgcttccttgcctgatgacaataaagcttgttgactcag

SEQ ID NO: 67348 - DNA, 415 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggccggcctctccagcctcagccccctgcttcagtcccttccccatgcttccttgcctgatgacaataaagcttgttgactcag

SEQ ID NO: 67349 - DNA, 208 bp, Homo sapiens
agaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccaagtgagtgggggcgcctgggg

SEQ ID NO: 67350 - DNA, 715 bp, Homo sapiens
  misc_feature (38)..(38): n is a, c, g, or t
ggcctggtggcgaattcggcacgaggcctaatgaccgnctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattggagatgaacgccctgcgaggccaggtgggtggtgagatcaatgtggagatggacgctgccccaggcgtggacctgagccgcatcctcaacgagatgcgtgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggcccggcctctccagcctcagccccctgcttcagtcccttccccatgcttccttgcctgatgacaataaagcttgttgactcag

SEQ ID NO: 67351 - DNA, 1030 bp, Homo sapiens
  misc_feature (1)..(1): n is a, c, g, or t
  misc_feature (895)..(895): n is a, c, g, or t
naaataaggctaggtacgaggctggtgttaatcggccgaggctctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcagangggattgtacgcgggggcccactggcgtgtcgaggcgagtggactttggctccggcccaggctgggaaatgggccccgtgatcggggccctggcaaccttgtgccccggtgggggaggccctaaggcaaatcggg

SEQ ID NO: 67352 - DNA, 1222 bp, Homo sapiens
gctgagctcaagctgggatctggcgggtgggtggggaggtagggagctccctcagaataaaggcagagggtaaagaccttgggagtccccacgtctccctcaagaagtcaggaactagcatcaagagccaggctacatgttctggcttgttctcaagtttccggtctgtgcctcccacacgctgggattaaccataaaaagttaacatttcaaatggcatgtttctgggctttgggatgtgggaagctggtgagaaggcacactctctccacagttagatttgggaggaggcctgacttgggagagggatccaggctcacaccgccctgtcctgtgtcctgtctgcagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcagaaaaaaaaaaataaaacagtaaatcaaacacaaagaagaggcgggggcgcggcgctaaaaaaatattcccgcccagagggcgcaagagtgtcgtgggacccccaggtttttttgtcacaaagtgggcgcccataaggagagcgggtagtataagcgagaggacgagcgcgcgtataaacaccgcttggattcggggaacactgatcgtgggattctgggaagggaccttacttctggcggtgacgatttgggacactact

SEQ ID NO: 67353 - DNA, 733 bp, Homo sapiens
gaggacagcagcatggagaaagatcctagaaaaggcctctgacttccttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggagggagaccaccagaggcataactcctgggatcgacc

SEQ ID NO: 67354 - DNA, 849 bp, Homo sapiens
  misc_feature (38)..(38): n is a, c, g, or t
ggcctggtggcgaattcggcacgaggcctaatgaccgnctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattggagatgaacgccctgcgaggccaggtgggtggtgagatcaatgtggagatggacgctgccccaggcgtggacctgagccgcatcctcaacgagatgcgtgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggcccggcctctccagcctcagccccctgcttcagtcccttccccatgcttccttgcctgatgacaataaagcttgttgactcagtaaaaaaaaaaaaaaaatgaggttttatttggggggggggaaagaggtttggaatgggcatggtatgttgttctgcccagtttttgtaaggggaattgcggtcctaggaggataatgaagcgttctgtttgaac

SEQ ID NO: 67355 - DNA, 1878 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcaggctaaaaaaaaaaaaaaaataaagaacaaaaccaacaaaaaaaaaaaaaaaaaaaaaaaaaaaaaaaaaaaaaaagaggggggggcgcccaaaaaaaaccccgaggggggcacacaaaagagacacaggcacaaggtgaggacaaacagaggggcgccacaaagaggcaggcgcaaaaagacaacaagaagcgcgacgacagtcacaacagcgcgcacggaaaaaaaacacgcgaaagaagacacacttggaagagacaccacaaactcggggggggacacacaagggggggagcacacacagcagaagaggcgccagaggcgaaatagaggcagggcacac

SEQ ID NO: 67356 - DNA, 1487 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctttctctctacctgaaacgatcctcaagtactaa

SEQ ID NO: 67357 - DNA, 1674 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccacaatggtacgcacctaccgccgggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67358 - DNA, 1610 bp, Homo sapiens
cagccacctgggagctggcaggtggccagtggtgatgaaagcccagggaatggaaacagaggagcaagcctgttgtaatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67359 - DNA, 1476 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaaggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67360 - DNA, 1143 bp, Homo sapiens
  misc_feature (1)..(1): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67361 - DNA, 677 bp, Homo sapiens
gtcactctagaggatctctagaatggcagagaaaacgcagatgcgaggatggtcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcag

SEQ ID NO: 67362 - DNA, 1004 bp, Homo sapiens
  misc_feature (1)..(1): n is a, c, g, or t
  misc_feature (862)..(863): n is a, c, g, or t
  misc_feature (877)..(877): n is a, c, g, or t
  misc_feature (885)..(885): n is a, c, g, or t
naaataaggctaggtacgaggctggtgttaatcggccgaggctctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtggnnaaaaccgaggtgcncgatggtntcccaaaacagggactaacgcgggggcccccctcggcggcgccgggaaaggaaactggccggccacgggctggagaaggccccaaaacgggaccgggagaccactggccccacagcgga

SEQ ID NO: 67363 - DNA, 802 bp, Homo sapiens
taggctaggtgagcctgctgtgattcggcgaggcaattggggcccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggagggagaccaccagaggcataactcctgggatcgacc

SEQ ID NO: 67364 - DNA, 294 bp, Homo sapiens
gaagctggtgagaaggcacactctctccacagttagatttgggaggaggcctgacttgggagagggatccaggctcacaccgccctgtcctgtgtcctgtctgcagacagaggaactgaaccgcgaggtggccaccaacagtgagctggtgcagagtggcaagagtgagatctcggagctccggcgcaccatgcaggccttggagatagagctgcagtcccagctcagcatggtaggaacagtcctgtgcatgggggagggcccagaagagggcattgaccatcctcactgacc

SEQ ID NO: 67365 - DNA, 567 bp, Homo sapiens
cattggcatcaggctctgtgaggatactgcgcgtccagctctgtttctgttccttttcctgccaggatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagattaaaaaaaaaaaaatggggttttgggggggaaaggtgaagccgtgtggtctgacg

SEQ ID NO: 67366 - DNA, 238 bp, Homo sapiens
tagaatcgagcgtcgaaccaggacattccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67367 - DNA, 171 bp, Homo sapiens
tactgctcgaattcaagcttctaacgatgtacggggacatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67368 - DNA, 1628 bp, Homo sapiens
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67369 - DNA, 1351 bp, Homo sapiens
  misc_feature (35)..(35): n is a, c, g, or t
taaagggcctgggtttacccgccccccccgggtancgggataggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67370 - DNA, 1910 bp, Homo sapiens
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagattaaaaaaaaaaaaaaaaaaaaaaaaaaaaaaaaaaaaggggggggcgcgcgcccaaaaagttatccccctggggggcgcccagctctttcgcgctgtctacccggctttctcttggtcacaaggggggccccttagtaggggggctcggtattaatagacgcaaggagccggggccggccggttttaacacacggttcggcgcgggggaagacctgcttcccttgtggccctttcgcgagggaccctttactctggggggcggacttctcggggcgctccctag

SEQ ID NO: 67371 - DNA, 1212 bp, Homo sapiens
aggctggtaccgtccgggaggtacggatcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67372 - DNA, 1299 bp, Homo sapiens
  misc_feature (35)..(35): n is a, c, g, or t
taaagggcctgggtttacccgccccccccgggtancgggataggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67373 - DNA, 1335 bp, Homo sapiens
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaag

SEQ ID NO: 67374 - DNA, 1564 bp, Homo sapiens
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67375 - DNA, 1648 bp, Homo sapiens
  misc_feature (806)..(806): n is a, c, g, or t
  misc_feature (839)..(839): n is a, c, g, or t
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcntgccatgatgtatgtagaagacagacggagaanccgatgatagaataccctaatgttacacaagccaaagaaaatgaaatggagccattccgcaaaaacatcagacacccaaaaagacacccagatcagagaaaaagtcagcaaacaacaaaaagatgaccgatgcgctgaacctaatgcacagcccaaacaccaatcaagcagagtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67376 - DNA, 662 bp, Homo sapiens
gggctgcaggaattcggacgagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67377 - DNA, 1299 bp, Homo sapiens
  misc_feature (1169)..(1169): n is a, c, g, or t
  misc_feature (1191)..(1196): n is a, c, g, or t
  misc_feature (1210)..(1211): n is a, c, g, or t
  misc_feature (1213)..(1213): n is a, c, g, or t
  misc_feature (1215)..(1216): n is a, c, g, or t
  misc_feature (1218)..(1220): n is a, c, g, or t
  misc_feature (1228)..(1228): n is a, c, g, or t
  misc_feature (1232)..(1232): n is a, c, g, or t
  misc_feature (1238)..(1239): n is a, c, g, or t
  misc_feature (1251)..(1252): n is a, c, g, or t
  misc_feature (1263)..(1263): n is a, c, g, or t
  misc_feature (1276)..(1276): n is a, c, g, or t
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagtttgaatgacttaccgagagagtagtggggaagaacctttttcacctgcctgtaccgnaaagggaccgttgggaaacagnnnnnngacggaaccgccgnncncnngnnngaaggggnaacnaacccnnaggcggggcccnnggggcgcccgnagcccgggggganaaaagcccggagggggcggggaa

SEQ ID NO: 67378 - DNA, 529 bp, Homo sapiens
actactactactaaattcgcggccactcgacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67379 - DNA, 514 bp, Homo sapiens
cattggcatcaggctctgtgaggatactgcgcgtccagctctgtttctgttccttttcctgccaggatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67380 - DNA, 538 bp, Homo sapiens
cgtgtctggccgcctctgccgtcggagctgtggccagcctggcccacatgtctgagagcacagtgaccgcagtgccgagatcactcagcactcaggaaggggcacgtgcggcacttcccgtgtggaagccgcccttgcttagcgtccagaggctggggtgctccagccacgctgctccccagcggccactcactcgagaagggatagacaagtgctgtttctgcacatcactcactgactttcttgtgtttcaggtcttgtcagcaagatttgtcctgttgagacactggtggaagaagccatccagtgtgcagaaaaaattgccagcaattctaaaattgtagtagcgatggccaaagaatcagtgaatgcaggtaggggatctgccaggaagacactggagaggtctccgtggctgtcaggagcattcctcagcagcaggctttctggctccaaatgaatatgccttaagccctcctgggcagaaatgcttctcagtgtctcagttctgctgtctgtagagtcgtggtttctggtc

SEQ ID NO: 67381 - DNA, 796 bp, Homo sapiens
  misc_feature (63)..(63): n is a, c, g, or t
atcttcagggcctggttgagctcgtcaatcaggccatcgcaaagtgcattgagggccttgggnggttcagttggatcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67382 - DNA, 1294 bp, Homo sapiens
ttcgggatatgtcgaccaggccctcggtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67383 - DNA, 1681 bp, Homo sapiens
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagattaaaaaaaaaaaaatggggttttgggggggaaaggtgaagccgtgtggtctgacg

SEQ ID NO: 67384 - DNA, 1960 bp, Homo sapiens
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagattaaaaaaaaaaaaaaaaaaaaaaaaaaaaaaatgtgtgtgtggggggcgcttgggcccttggaaaaagtttttaaaaccattcgggtggggggggggggccccatgtggtgataagtgaaaccggggcacaaagcggtgtttcccagggaaaaaccgcgggacgcaaggacaaaagggcgcggggggaatctcccacccataataaaaaagcgcccggggcggaaaccggaacggtcttctgaaactaatcccagaaggggagtccgagaggccactcgcgggggactctattcacccggggagctccaaagcgaggccggaaataaaaatacg

SEQ ID NO: 67385 - DNA, 1667 bp, Homo sapiens
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagattaaaaaaaagtcgacggccgcgaatttagtagtagtagtcg

SEQ ID NO: 67386 - DNA, 1575 bp, Homo sapiens
  misc_feature (1490)..(1490): n is a, c, g, or t
  misc_feature (1500)..(1500): n is a, c, g, or t
  misc_feature (1565)..(1565): n is a, c, g, or t
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccgctgtctctggcngcgtgtcgangcagcgggcagtggtctgtgtctgcgtgtagagggctgctgagtagtgtgctgctcaaaagtgtnatgaactcat

SEQ ID NO: 67387 - DNA, 1243 bp, Homo sapiens
gcagaacggtaatcggcagaaatgccgtgtgtgctctgcgcggcgctgaggccttcgctgtcgccgcgtctgtgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67388 - DNA, 1570 bp, Homo sapiens
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67389 - DNA, 989 bp, Homo sapiens
tcctttccactcctgctagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67390 - DNA, 1266 bp, Homo sapiens
ggtgacagaagacgtgcggagggagacgcagagacagaggagaggccggcagccacccagtctcgggggagcacttagctcccccgccccggctcccaccctgtccggggggctcctgaagccctcagccccaaccccgggctccccatggaagccagctgtgccccaggaggagcaggaggaggtggaggtcggcttgaatgcccacggtgcgcccggggacccctgtagccccatccacgctcctagcgcgcgtgccctagatggtcaccgggcggggatagggcctttgcacgctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67391 - DNA, 904 bp, Homo sapiens
ctgcccctgatgttcccgggctcttgtgctgcctggcctctgacccctggacctagtctcagggcctatcttaagccccttggaatttgctggctgcacagctgtgatgtcttcttgggttcactcatcacagtgccagccatgaccagcccctccctgcaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67392 - DNA, 1290 bp, Homo sapiens
  misc_feature (35)..(35): n is a, c, g, or t
  misc_feature (448)..(448): n is a, c, g, or t
  misc_feature (481)..(481): n is a, c, g, or t
taaagggcctgggtttacccgccccccccgggtancgggataggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcntgccatgatgtatgtagaagacagacggagaanccgatgatagaataccctaatgttacacaagccaaagaaaatgaaatggagccattccgcaaaaacatcagacacccaaaaagacacccagatcagagaaaaagtcagcaaacaacaaaaagatgaccgatgcgctgaacctaatgcacagcccaaacaccaatcaagcagagtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67393 - DNA, 1208 bp, Homo sapiens
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcaccggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagaaagggactctgggggatgacgggggtgggatcatgggagacgtcagtagtatttgtcccgagtctcca

SEQ ID NO: 67394 - DNA, 1217 bp, Homo sapiens
ggcgggcggggggaggcggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggaggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgcccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagatcttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgtgggtccttgtgtccctgccgctgaagaatggggctgctctgagggaaacgctgtctgctgccttcatacagatgctgattaaagtgatagcgattcagatta

SEQ ID NO: 67395 - DNA, 703 bp, Homo sapiens
gtgatgtcttcttgggttcactcatcacagtgccagccatgaccagcccctccctgcaggtgcgggcggcacccagagactcacccgtgctgttgggaagtcgctggcgatggagatggtcctcaccggtgaccggatctcagcccaggacgccaagcaagcaggtatgggttggggctgcccgcaagagccacctggaaacccggggtgggagccccacagaaacccagggcggcatccaggtgtccccctcgggggagccccacagaaacccggggcagcatccaggtgtccccctcatgggtgccccacagaaaccctgagctgcatccagttgtctccctcgtgggagccccacagaaacccagagctgcatccaggtgtcccccatgggggagccccacagaaacccagggcggcatccaggtgtccccctcgtgggagccccacagaaaccccgggcagcatccaagtgcccccacggtggttgcatgagcttttgggtcctgaggacctgggagaagactgactgccttttgtttctacattttgaagtactgtatgtacggaagtgaaccacacgtaagtatctggtacagaataacagcccagcaattgcgtccccaaaatgcagtgtaagcaatgggcatctccaggcctcagtggccggtcctcccactgccctgttggtgatcacagtccc

SEQ ID NO: 67396 - DNA, 702 bp, Homo sapiens
caatcaaacccataaataccacagactctaatagccatggattgctgtgcctctcgaggctgcagtgtccccaccgggcctgccaccaccatctgctcctctgacaaatcctgccgctgtggagtctgcctgcccagcacctgcccacacacagtttggttactggagcccacctgctgtgacaactgtcccccaccctgccacattcctcagccctgcgtgcccacctgcttcctgctcaactcctgccagccaactccaggcctggagaccctcaacctcaccaccttcactcagccctgctgtgagccctgcctcccaagaggctgctaatggatggctactttgctcagtgcctgagattgaaaaagtcaacatagaagctttagcattcacctatctcagtacctacaactaatgtactctgctttagaaattggaacaaggatggtactaccacaatcaccccctgcaaaaaaaaagagaccaagaaactttcaatgaccattcagctataaccaactgcagtttgaatcagtggatgcctatagcttcctgaagctgttcgattccttcatattaaagtgtctctttctgtgggtggtttgggaattctgttttcagtcttgggtggtatctttctgaaaattaaggaagttcttcatgattatcctaataaattttacatctctggcatagccc

SEQ ID NO: 67397 - DNA, 613 bp, Homo sapiens
  misc_feature (192)..(192): n is a, c, g, or t
agtcgtgagccaccgtgcctggccatcaaagcatttttaatatagaaggtcagttgagttgctgcctaggatgcaacctgatcttaatttacaaagtaattaaattattataaaataagtttgcattcatagattaaaaagtacacatttattttattattattatttttttttgagatggagtttcgctcnttgttgcccaggctggagtgcaatggtgcaatcttggctcactgccacttccacctcctgggttcaagtgattctcctgcctcagcctcccgagtagctgggattacaggcatgcgccaccatgcctggctcattttgtatttttaggagagatggggtttctccatgttggtcaggctggtctcgaactcccgacctcaggtgatctgcccacctcggactcccaaagtgctgggattacaggtgtgaaacaccacgtcctgctaaaaagtacacatttaaaatctaagttccattttcccgtcatgtttattaatttgtcccattgcaggatatgtttctgttgtccgcatgggtagagataattttaaaagcttggttaagtaagaactgattttcttaattattgccctttaggtta

SEQ ID NO: 67398 - DNA, 3668 bp, Homo sapiens
ataggtatttcaggacagccaggagggggcgcacatccgccgagaaactgtgagcaagagcgtctgtgctgaaccatggcgccaccagagggcgcgcgatcccgccccaaccaacttcccgctgaagtgccagaagcagcgaggagcttcaacttcctcagggcagcacggggatcgtgttaatttggtgttcttcattggtgatgattattccccaccttctaagagacaaagaccaacgagccaccacagccaccagtcccagaacctgccaatgctggggaacggaaaatgagggagttcaactctggccctcacaatccagtggaggagacgaaactcatctgcctctgtccctctgggcacgcctcatgccaggtgcatctgtggacaggggccatgctcctgggcttccaaagttggagagagctgccaggctcaggtctgaaggccagaattctacagtaagtcctactgagtcaaggtgggagcagggtcggtagcttccgaggctctgcgggagaatccgtttcctggccgtagaggtggcctgcactccgcagcttgtgctgcccgtctcgaatgactggagtttcctgcttctgtcactacacctcccaccctctccatcacctgctctgctcttacaaggatccgaagaaatggaatcatcgtatcgctgatctacgtaaacaaactgaagaattgtctgaaagaaaatatgacatgaacttatgaattcaacaggtgaagatttacaacttgataaatcaactttgtcagctcgagctgtaaaagccaaaggtccggtgatgatcccatacccttttttccagtctcatgttgaagatttttatgtagaaggccttcccaaaggaattttttttttttttttttttttgagatggagttttcactcttatcgcccaggctggggtgcaatggcgcaaccttgctggtcactgcaacctctgcctcctgggttcaagaaattctcctgccttagcctcccaagtcactgggattacaggtgcccaccaccataccaggctaatttttgtatttttagtggagatgcggtttcaccatgttggccgggccagtctcgaactcctgacgtcaagtgatcttcccgcctcgactcctgatatcaagtgatcttcccgcctcggcctcccagagtgctgagattacagacgtgaacccatgcctggccaggaattttgttttttaggaaggctttctactaatggaattcctggccttgagaggatgttactttagaaggaaaggatttttttgttattaaaagctggacctaccatgaaagacttctgaatccaagaagagaaactgactgggcaacatgttattcagaaacaggaccttgccctgtcactcaggatagagttcagtggtcctatcatggctcattatagcctcaaactcccaggctcaagcaatcctaccatgtcagccttcccagtagctgggactacagataccgggtctcacactgtcacccaggctggagtacagtggcacaacctctgctcactgcagcctccacctgccaggctcaagcaattctcctgcctcagcctcccgagtagctgggattacaggaagtgagctcacaatgactcaagctgccacatactgttgattgtgaaatgccagttgaagcatatgtcctgcaagcttaggggtgctacaagttgaccactgcagcagtaaagatgactctgaagaatggcgtgggatggttcctttcaaatgcacttgagcagcggtctccaaccacagggccacagagctggagctggatctaccatgaaagacttgtgaatccaggaagagagactgactgggcaacatgttattcagaatctccctgtgccatccaggctggagtgcagtgatgtgatcatagctcgctgtagctttggccttctgagatcaagcaatcctcccatctcaacctcccaagtagctgggactacacatgcatgtcacccatgcccagatcatttttgtagagtcagagtttcaccgtggtggccaggttggccatgttggccaaatggggtcttcttttgttgcccaggctggccacaagttcctgggctcaagtgatcctcccacctcgtccttgtagagatgagatttagttatgtcgtccaggctgatctcaaactcctgggctaaatcgattgactcacctcagcctctcaagtatgttatgaaggttatatgttaggaagggtcccaggaggtagacccacacagatgggatttgggcataggtttggtttcccagggggcagtgctgagctctttgccagtgggaaatgggatgctggtgatttccagtaggtgacctcacagtgactcaagctaccacttactgttgattgtgacgaaatgccagctgaggcacatgccttgggagctaagtggttgctgcccttgaccactgtgaagactggtgtgggaagggtcgttttggatgcacttgagcaggggtccccaacccctgagccatggagccgcaaggagccacacagcaggaggtgggaacatccagttgcaggaaaacaagcttaacacgcccactgattctacattatgctcctacctcccggcagcctctccaggcccagaactttctccagtcagcctctacagaccaagctcatgactcaaaatggcctatttaggcccataccctacgtcacggcagcctccgcagatgaggctactgcctcacaacagcctccacaggcacagctccatcgttacaatggcctctttagacccagctcctgcctcccagccttctctccaggccctgaacattctcaggtctccctctgttgtccaaggctggagtgtagtagtgctatcgcagctgactgcagcctcaaccttccaggctgaagcgatcctcccacgtcgacctcccacgtggctgagactacaggtgcttgccactatgcccaactaatatttggaattttcatatacgtggattccagaggggtgacagcgaaacgtgactgcaggacaagttcgagcatcttaaaatgattcaacaggaggagataaggaagctcgaggaagagaaaaaacaactggaaggagaaatcatagatttttataaaatgaaagctgcctctgaagcactgcagactcagctgagcaccgatacaaagaaagacaaacatcgtaagaagcaatagtttctcttactattctgagagccttattctacatcccatcttcctgtgagtttgtctttgtagcatttaactctaattgcagttctcattttaaaaactggcttgcttattgtatattttccccaactaaagcgtgaactcctagcagggcgtggtggctcatgcctgtagtctcagcactgtgggaggccgaggtgggtcgactacctgaggttaggagttcgagaccagcctgaccaacatgatgaaacgctgtctctactaaaaatacaaaaattagctaggcgtggtggctgggacctgtaatcacagctacttgggaggctgaggcaggagaatcacttgaaccctgaaggtggaggttgcagtgagcagagatctcaccagtacactccagcctgggtgacaagagcaaaactgcatctc

SEQ ID NO: 67399 - DNA, 502 bp, Homo sapiens
ataggtatttcaggacagccaggagggggcgcacatccgccgagaaactgtgagcaagagcgtctgtgctgaaccatggcgccaccagagggcgcgcgatcccgccccaaccaacttcccgctgaagtgccagaagcagcgaggagcttcaacttcctcagggcagcacggggatcgtgttaatttggtgttcttcattggtgagtaaaaagctcctgtccacggccctgagtgccaaggagtgagtctttagagcactcagcagaggaagaaattcatctagaaaaataaagcccccaaatctcactatttggagtacaccctaatatcattgtcaacgtccaagacacagtggctgctaatatatattcttacagtggcctctaatataataatcacactgtgctctacattactatgatatctacactgtgccctaacacctatataatattcacaccatgcgctaacactgatgtaatccacaacatcgcttccaata

SEQ ID NO: 67400 - DNA, 1048 bp, Homo sapiens
ctagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactgactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaa

SEQ ID NO: 67401 - DNA, 1056 bp, Homo sapiens
ctagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactgactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggcaggaaggatacatcacctatgcagtatttttcccaaaaatgcttaacttgaatttcatcatgaggaaacagacaaatctggattgtggtcgacg

SEQ ID NO: 67402 - DNA, 590 bp, Homo sapiens
accaggtggtggcaggaggaaatgttcccagtgggggtcattaaaagcgaagccaagagaaagtcctcgcagttcagcaagtgtctaagttgccaaaatggcacgttctaatgaacctcaacaaggcaaccttgcctctccttgagccagaagcccacatcaaatagaagcagggctcacagtagagattcaagctctcaggtgtgtttaaggaattcaaaaaccatgaaaacaaactacgggaaaaataatctgaacttgaaaagtataaaaaaaaagattactacattattaggaaaaactacaggtttatgattatcaagcagtcatagtgacagaaatttcattaatcagaagtcctgctgctcaaatgataaataaaaatacatctcaatgatttcatttaatgcatgtgttcacatgggtgccgcagtgtgatcttaaagttgcataaaaacagggtttcttgggcccagcgtggtggatcatgcctgtaatcccagcattttgggaggccaaggtgggaggattgcttgaggccaggagtttgagactagcctgggcaacatagcaagattctatctctactt

SEQ ID NO: 67403 - DNA, 227 bp, Homo sapiens
gtccctgcaatggctccctgttgtctaagacatcaagtttggatgtatggatcttccccctgggcaacccctgatctgaccttgccctcccatcgacccatcatggccagctgctccccacacgcacccatccatcaggaagatgccctccatggacaccccatgctgcctgttgccatctctctccacccctgcacagagcccctccttcaaggcgaacagcctct

SEQ ID NO: 67404 - DNA, 781 bp, Homo sapiens
cacgcgtccgcggacgcgtgggctcagactcagccaacagagattgttgatttgcctcttaagcaagagattcattgcagctcagcatggctcagaccagctcatacttcatgctgatctcctgcctgatgtttctgtctcagagccaaggccaagaggcccagacagagttgccccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccttaaataataaaaataaacatgtttccacta

SEQ ID NO: 67405 - DNA, 1192 bp, Homo sapiens
cacgcgtccgcggacgcgtgggctcagactcagccaacagagattgttgatttgcctcttaagcaagagattcattgcagctcagcatggctcagaccagctcatacttcatgctgatctcctgcctgatgtttctgtctcagagccaaggccaagaggcccagacagagttgccccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccttaaataataaaaataaacatgtttccactaaaaaaaaaaaacagaaaaacaaaaaaaaggcggcgaccggcacaaaaaaataacccacaggggggggccacgaaatataaacattaccccagagtagcggcgaccaaggtggccccaaatgaagggagccgcggaccatacaacaccaggacaagggccacgacgattacacaacggcccgagccgaggggcaaaaccggcgcgcccggggggcccccgtgggagagcgacacaccacaccaccgggcggggcgcaccaaccaggcgagccaaccacccccacacacgagatataagaccccgcagcggaccaataaaacagtcaacagtaccaataggtcgacacacaccacgccactattaagacggccaggacaaagtggacgaccggaagagagatgtagcagacat

SEQ ID NO: 67406 - DNA, 954 bp, Homo sapiens
gaggttttagctgtaatgaagcctcagtgggatccaaagttgtttttcagttactgagtctgtataatccccactctcaagagaaacatttgaaggtgtgggtgtctcagaggaccttcctggtctcagaaattctgagaggaggttttaaggaaggtaataggtgctttgctctccatctctcagaacccccttccctgtgttctcctacagagattgttgatttgcctcttaagcaagagattcattgcagctcagcatggctcagaccagctcatacttcatgctgatctcctgcctgatgtttctgtctcagagccaaggccaagaggcccagacagagttgccccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccttaaataataaaaataaacatgtttccacta

SEQ ID NO: 67407 - DNA, 799 bp, Homo sapiens
  misc_feature (27)..(27): n is a, c, g, or t
  misc_feature (34)..(34): n is a, c, g, or t
  misc_feature (56)..(56): n is a, c, g, or t
acgactcacttcaagaccagggtgggnaccgggnccccttaccccagcgagtgggnagagattgttgatttgcctcttaagcaagagattcattgcagctcagcatggctcagaccagctcatacttcatgctgatctcctgcctgatgtttctgtctcagagccaaggccaagaggcccagacagagttgccccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccttaaataataaaaataaacatgtttccacta

SEQ ID NO: 67408 - DNA, 547 bp, Homo sapiens
  misc_feature (82)..(82): n is a, c, g, or t
  misc_feature (145)..(145): n is a, c, g, or t
  misc_feature (159)..(159): n is a, c, g, or t
aaattttcgggggggccaaaaacctttggggtggtttcttggtgggctttcaaaaccccaaggggccggggagggggtgccnttttggtggggccttcaactgggattaaaggggaggagtggcaactggatggactttcaattntgggatggcttcanggaccccaaaaaggaaccgccgctggcactggagcagtgggtccctggtctcctacaagtcctggggcattggagccccaagcagtgttaatcctggctactgtgtgagcctgacctcaagcacaggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccttaaataataaaaataaacatgtttccacta

SEQ ID NO: 67409 - DNA, 976 bp, Homo sapiens
cacgcgtccgcggacgcgtgggctcagactcagccaacagagattgttgatttgcctcttaagcaagagattcattgcagctcagcatggctcagaccagctcatacttcatgctgatctcctgcctgatgtttctgtctcagagccaaggccaagaggcccagacagagttgccccaggcccggatcagctgcccagaaggcaccaatgcctatcgctcctactgctactactttaatgaagaccgtgagacctgggttgatgcagatctctattgccagaacatgaattcgggcaacctggtgtctgtgctcacccaggccgagggtgcctttgtggcctcactgattaaggagagtggcactgatgacttcaatgtctggattggcctccatgaccccaaaaagaaccgccgctggcactggagcagtgggtccctggtctcctacaagtcctggggcattggagccccaagcagtgttaatcctggctactgtgtgagcctgacctcaagcacaggtgagaggcagagaatccatccacctgtttctgttctctcctgcttagctccagggatggaactgggactgggatagaggaaaggtgaactcctcattaaggaaatgaatgtttggtttttgtcctgagtcctaaagccaggagggtcatactctttcgggtctcccagttgtaactcttctcattgacttataggattccagaaatggaaggatgtgccttgtgaagacaagttctcctttgtctgcaagttcaaaaactagaggcagctggaaaatacatgtctagaactgatccagcaattacaacggagtcaaaaattaaaccggaccatctctccaactcaactcaacctggacactctcttctctgctgagtttgccttgttaatcttcaatagttttacctaccccagtctttggaaccttaaataataaaaataaacatgtttccacta

SEQ ID NO: 67410 - DNA, 602 bp, Homo sapiens
ttatttatcctgtgctttattggtgaacacttaggttgtgtgttagagtatagtttaagcttctggaaataaaaaaataccctcctatatgttttgctttaaacaaacaaatttgtttctgtttattaaacagttgagaggaaagtggtagctggtagggaactctgcagtcctttattacacagcttctgtctctgaatacaaaatggccatagcagcttcattcagctatatgccagccagcaggaaacaggaagaacagtgcatgctactcctattacatgtcacccagaagttctggcatatatcctgttggccagaaagtcatcacatggccattcccacttacaaagatggttgggaaatctagctatgtaattggctaaaatgcaggagttctgctgttaaaggagaaaccaaaagaacattgctggatacttaagtagtactgtcagttacccacagattgtcttctaccttgctactatcaataatgtaataaatatccttgaaaatgtttttgggtacacatgtaagtatattttcaggataaattcttaaaagtagaattgcttagtcaatggatatgtgcatcttttatt

SEQ ID NO: 67411 - DNA, 177 bp, Homo sapiens
tcgcttctcacttccccatgctgccctggacgccaggcctttggagggcaggcccgggttgtgtgttccccacggagccttgcgggccctcagtggatgtgtggagtgagatgagtatcttccgtgactgcagggcccctcgtatttctggtgcgttgcttggtttgagtttcacac

SEQ ID NO: 67412 - DNA, 628 bp, Homo sapiens
tcttgaggccagcatttttaaaaatgtgagatcagctttgaatggaaactaggtctctgatctaaaaaacaatgggcagaaagatttactctgcttctgtttagcatttttatcagtataaatttaggcagaagcctgagtcttaaaagtttagattctaaggcagggttccctaaataaaacaccttccgtgctcagtgtgaaagagtccattggcctgttgccaaaccagaatctaaatgcctagtcattcaaattaaatttaaaaacagaagcaaaacaaaaattagcactccacaaaacatattttaaggctggatctggctccagactaagagttaatgatgcttgaattaaagataggaaaatggaagaaggtggaaatgccaagaagtggatgttgttattgataacttttttgtataaccaatataaatgtaattatctgcctaaaaaagaaaaagaagaccctttatccctttaaatcattttcagaaatgtctgcataatgagttgagtttcattccctctaatgcctaaatgacaccttgtaataaattaccagctttgttaaataaggttttaactcctctgggcccctcagacaccgttgatatactaaccagta

SEQ ID NO: 67413 - DNA, 734 bp, Homo sapiens
atttcaggttcttgggggtagccaaaatgaggttctttgtccctctgttcctggtgggcatcctgttccctgccatcctggccaagcaattcacaaaatgtgagctgtcccagctgctgaaagacatagatggttatggaggcatcgctttgcctgaattgatctgtaccatgtttcacaccagtggttatgacacacaagccatagttgaaaacaatgaaagcacggaatatggactcttccagatcagtaataagctttggtgcaagagcagccaggtccctcagtcaaggaacatctgtgacatctcctgtgacaagttcctggatgatgacattactgatgacataatgtgtgccaagaagatcctggatattaaaggaattgactactggttggcccataaagccctctgcactgagaagctggaacagtggctttgtgagaagttgtgagtgtctgctgtccttggcacccctgcccactccacactcctggaatacctcttccctaatgccacctcagtttgtttctttctgttcccccaaagcttatctgtctctgagccttgggccctgtagtgacatcaccgaattcttgaagactattttccagggatgcctgagtggtgcactgagctctagacccttactcagtgccttcgatggcactttcactacagcacagatttcacctctgtcttgaataaaggtcccactttgaagtcactggct

SEQ ID NO: 67414 - DNA, 436 bp, Homo sapiens
gggattggttccaagttgggtattgcccctgcatgaatcacacgggactgagtctggcctctccttggggactctaaaagctggctaggtccattaccatgagagtcccttaggattaacaggccttttgtttgcctgaaatattcttcaaattctgagtcttaaaattctaataactcttaaggcaaagtactagtagcatctgtctgtgaacacttaacctgatttctctcactcagaagcaattattcctgcccaattatatagtatactagttgtaactatttagcatataggttttctgaattatatgataatgtttatatatcttaaaagataattttcataaaaaggtaagatcatgactcatacagatataaaaatgaacatgcattaaacatttaattcatgagggaaataagtagatgtttcaact

SEQ ID NO: 67415 - DNA, 242 bp, Homo sapiens
agattttatagaccagtggaatacaggccttgtcatatgaagatcaggtgacaagtatgctgcctaccagcctccacagcaatatgccctttcacgaatccaaaggactgcatgacacaccataggatatagtcaagaagcctttggacatgggagtttcaagctcaaaggagaattcatacctgaagagaaatttggaagccatcaatacattggtagttgataagctcatgaaaagagat

SEQ ID NO: 67416 - DNA, 612 bp, Homo sapiens
gaggaagttgaagaggaagcagcaggtttccaaatatttcaaccgcaaatgtattgttatcattcttcttattatttatttgtttgttttgtttttttgagacggaggctcactctgttgctggcacgatctcggctcactgcaacctctgcctcccgggttcaagaaattctcctgcctcggcctccctagtagctgggattacaggcatgcaccaccacgcccggctaatttttgtgtgtttttagtagagacagggtttcggctggtctccaaactctgacctcaggtgatccgccctcctcggcctcccaaagtgctgggattacaggcgtgagccaccgcacccggccctataattctttttattattatcattattatcattggtgccttttctttgttgtaaaactgtatgccgattgactatttggcaaatgtagaaaagtaggaaagaaatcatccatagtaccaggacacaatcactctggatattttggtgtgtttcctttcagtcttttttccatgcacaaccattttcatataattttatcatactgtatctgcaacttttatgtcctgcttttcccttgaatattgtgtcataagcat

SEQ ID NO: 67417 - DNA, 488 bp, Homo sapiens
gaggaagttgaagaggaagcagcaggtttccaaatatttcaaccgcaaatgtattgttatcattcttcttattatttatttgtttgttttgtttttttgagacggaggctcactctgttgctggcacgatctcggctcactgcaacctctgcctcccgggttcaagaaattctcctgcctcggcctccctagtagctgggattacaggcgtgagccaccgcacccggccctataattctttttattattatcattattatcattggtgccttttctttgttgtaaaactgtatgccgattgactatttggcaaatgtagaaaagtaggaaagaaatcatccatagtaccaggacacaatcactctggatattttggtgtgtttcctttcagtcttttttccatgcacaaccattttcatataattttatcatactgtatctgcaacttttatgtcctgcttttcccttgaatattgtgtcataagcat

SEQ ID NO: 67418 - DNA, 708 bp, Homo sapiens
ttggagcagtggcttctggctttctgattatggctgttgcctgcaatttaaagtcctaatgttcattttgtttgaagagggatggaggaggagttagacacatggaatgtgtgtgtgtgtgtgtgtgtgtgtgtgtgtgtgtgtgtgtgtttcaagatgaactcaatagcatcaacaaataatgagggttcagaaagtttatatttaacttgttgaaaatccacctagctatgagcctaatttcctgaagaataaatgtaaggtgagatgatatgttttggataccaataagatccagtacctgctacgtttatagggatagaaattgaacaaatggcaacatttcaaaatctgccaaaaagagccccaactgattgttttcatgtttataatctccaacttacagaatttcacagaggaacaagccgtaaagttgcctgaagataagtcctggctatgaattaatgttgaacaacatgaaaagattacaggtacttggaaataaacttctgaggaactcatcagaatttcaaattatgcaagtattatgataatacttgagaatctcaaaatcatttcaactatcaatttctgtgggattttataataatttgcagcttcaatgacaaaataatttaaaatgatgttttctaactctacctacacaattattctgactttataggaaataaattacatttatttgga

SEQ ID NO: 67419 - DNA, 366 bp, Homo sapiens
tgagacatgatttatcttcatcattctcacttttctgggagtaggtctcttggccttctttatctggttttttaaccttcatcccatatggatacactgtccaagttacggtaagtgctgctcataggaaaataaatggaaatttgccttgtggctaggtcagaattcaacagaaatcctgggttactaggtaaccttttttttgagatggagccttgctctgtcgcccaggatggaatgcagtggcacgaactcagctcactgcaaactttgcctcccgggatcaagcgattctcctgccttagcctcccgagtagctgggattacaggtgcctgccaccacgcccagctaattttttgtatttg

SEQ ID NO: 67420 - DNA, 571 bp, Homo sapiens
tggaatccttttgtggattcttgaatgacaaggtgggtggaatatctaatgaatgggggaatctctctcatattgtgtataaaaatatcatagttaataaaatgttaagtgaattccaaatcaaattcagaatcatagaggggatagatcatttccccagtgttttcatcttattctaactttaagctaaatttttattctttattcagttattctagtaaaaatgtggtgatagaggtgatgaaggggccttaagaaaaaacttgaggccgggcacggtggctcacgcctgtaatcccagcactttgggaggccgaggcgggcggatcacgaggactggagtttaagaccagacttcctaccgtggtgaaaccccatctctactaaaaatacaaaaatttagccaggctggtagcgggcacctgtaatcccagctactcaggagcctgaggaaggagaatcacttgaacccaggaggtggaggttgcagtgagctgagatcatgccactgcactcgagcctgggtgacaagagcgaaactctgtgtcaaaaacaaacaaacaagcaaaca

SEQ ID NO: 67421 - DNA, 334 bp, Homo sapiens
cttaccatggatgtatatccatgcctaggcacagcctggtgaattactttccggaaaaaaaaagtttgccttaagatttaattaattttcacagtttaataatatctcagggcatttattctgcatttaagataaagagcatagatttgtatatattatggaaataaatggaattctcattttgataagaaaatgtgaaagcccaacccatttaccagcattgataagagggagagatgggacgtgtttgcgcacttagtggatgctcatttggctatatgtaaagaagactttaattttcataatatatatttagaaccttaatatgtgaata

SEQ ID NO: 67422 - DNA, 1069 bp, Homo sapiens
cattggcgtttttttggtcttacgccctagggtggggagaggactccggtgcctccgggtctgggctgggccgcaaagggcggggcctgggcccggcgcgggccgggagcagaggccgagaccctgcaggtgattcctggggctgccagctaaggtcccttatgatttctgctctggctttgcagttttcagcctttcccaagagcagcagaaaatgaacaagttccagggacccgtgacattaaaggatgttattgtggaattcaccaaggaagaatggaagttactgacccctgctcagaggactctgtataaggatgtgatgctggaaaactatagtcaccttgtctcagtgggttaccatgtgaataagccaaatgcagtcttcaagttgaagcaaggaaaagagccatggatattagaagtagaatttccacatcggggcttccctgaagacctatggagcattcatgatctagaagcaagataccaggaaagccaagctggaaattcaaggaatggagaactcacaaaacatcagaaaactcataccacagagaaagcctgtgaatgtaaggaatgtgggaagttcttctgccagaagtctgccctcatagtacatcagcatactcactcaaagggcaaatcctatgactgtgataaatgtgggaaatctttctctaaaaatgaagacctcataagacatcagaaaattcacacgagagataaaacctatgagtgtaaagaatgtaagaaaatattttaccacctatcatctctcagtagacatctgagaacccatgcaggagagaaaccctatgaatgtaatcagtgtgaaaaatccttctaccagaaaccacatctcacagaacatcagaaaacacacacaggggagaaaccttttgaatgtactgaatgtgggaagttcttctatgtgaaggcatacctcatggtacatcagaaaacacacacaggggagaaaccctatgagtgtaaggagtgtgggaaagccttttcccagaagtcacacctcacagtacatcagagaatgcacacaggggagaaaccc

SEQ ID NO: 67423 - DNA, 1092 bp, Homo sapiens
cattggcgtttttttggtcttacgccctagggtggggagaggactccggtgcctccgggtctgggctgggccgcaaagggcggggcctgggcccggcgcgggccgggagcagaggccgagaccctgcaggtgattcctggggctgccagctaaggtcccttatgatttctgctctggctttgcagttttcagcctttcccaagagcagcagaaaatgaacaagttccagaagaatccattgccaaattcaagggacccgtgacattaaaggatgttattgtggaattcaccaaggaagaatggaagttactgacccctgctcagaggactctgtataaggatgtgatgctggaaaactatagtcaccttgtctcagtgggttaccatgtgaataagccaaatgcagtcttcaagttgaagcaaggaaaagagccatggatattagaagtagaatttccacatcggggcttccctgaagacctatggagcattcatgatctagaagcaagataccaggaaagccaagctggaaattcaaggaatggagaactcacaaaacatcagaaaactcataccacagagaaagcctgtgaatgtaaggaatgtgggaagttcttctgccagaagtctgccctcatagtacatcagcatactcactcaaagggcaaatcctatgactgtgataaatgtgggaaatctttctctaaaaatgaagacctcataagacatcagaaaattcacacgagagataaaacctatgagtgtaaagaatgtaagaaaatattttaccacctatcatctctcagtagacatctgagaacccatgcaggagagaaaccctatgaatgtaatcagtgtgaaaaatccttctaccagaaaccacatctcacagaacatcagaaaacacacacaggggagaaaccttttgaatgtactgaatgtgggaagttcttctatgtgaaggcatacctcatggtacatcagaaaacacacacaggggagaaaccctatgagtgtaaggagtgtgggaaagccttttcccagaagtcacacctcacagtacatcagagaatgcacacaggggagaaaccc

SEQ ID NO: 67424 - DNA, 242 bp, Homo sapiens
gacttatctctgaagtctgtaggagataacttcctccccattactagccagcagggtggcctgagtttccttgtctggagctgcaggatatttgttctatcctgtttacagccaatggggggccctttttcttccctacagtgagccttttcatctgcacagagggagatacaaaatcggaaatgatcttaattaaatgttttccgtccagaaacaactagtccactaccttgatctggcgg

SEQ ID NO: 67425 - DNA, 2087 bp, Homo sapiens
caggctcttcttgtgcctttaaaaatatatcttgaagattttaataaccccagtttcagttactgaggtggttatgaacaaattattacgttccccttattgaaacagtatttatctgttaattcttcgttgttggcatgatgtatgtggtgtttaaaaattcatcctcttagctgcactggggccttttacagaatgagtgtaaaggcacggtgctgaaggctgggagaaggaaccagaacagttttctataggtcatgaagttctactggtaactttctcctgtaaattatccttgtaatatctttgagacatgattttacggtgtctgaacacttccagtaatgtttaaactgttgattgctggacagctccttttgaactgtaatccacttccgtctgctttatgcacattgactgtagttccattctcttgagcatcatacacactataaatgcaaagcaccaagctttaggggtggagggcaggttgaacacataattctgtttacagaatttgcctgataatctttatgcttgtaagactatccacttgggacggacttctaaaacatctttgcgtatttgttctttttttttcctttctgtcttattgcaataatcccaaagatttttacctgctttgtctaatgatattgtctactttgaagaagagtcaattcatgatgatcctgaacagtgaagattcttcgaaaacttttttttttttttttttactttccattatggtgaattatcttgaacaagtactattgactgtgagtgggagacactcttctgaacgttgtagaaaatgtagagtggagattagacatgggttgttcccttgagaactcaagtgttggtattcagtgttctcatgttaggatctttgtaccttcagttctctttattcctgaagtgctgtgcttttccctcagtgcccttctcatcattcaaatttctgctcaaatgaaacctcctcagagagacttcccctgatgacactaactaaaataactcttttctcccatcattctctattttatcatgttttatattcttcatgataggcatcactatatgatatggaatattcttaagtgtttacttgtttgtttttttgtcttcaccttctagaatgtaagtttgcaagggtagggactttgtcttgtttaccactgtttcttcagtacctggcatataatgggcagtcaataaatactttaagattattaagctaccaatactgtaaattctgtttttgacaaggagaagctactgaagtagtataacctaggaaaaaacttaccttgaatggtacattccagtaactgaaacttgcagcaaaaaatcttaaccattttggggttacatacaccattgagaatcttataaaagctatgtattttctttctttctctctccttcctccctctgtccctccctccctcctttcctctcttcctggccccctttccctttctctttccctttccctgggtctcactctgtcacccaggctggagtgcagagtcatgatcacagctcactgcagcctctacttctagggctcaactgatcctcccacctcagcctcccaagtaactgggactacaggcacatgccaccatgcctggctaattaaaaaaaattttttttgtttttggttgagatgggggtctcattgtattgtccaggctggtgtcgaactcgtgggttcaagtgatccttctgcctcagccttccaaagtgctgggattacaggcttgagcaactgcactcagcctaaaactgtatgttctctctagaaaaaggtacatactcttattgtactcagaatttcagtatcaattcagagaattctcagaacccagaaatccctgctttgaagaaaggaataaccctgagtatttgaaaattcttaaaaatacatgttgttatgtcttccatttttgcccattgatgtgcatgaaacaagcacagttccctttccacatgaaagcctttaagatagtcttttaacaaatatttatgatgtaccatatcacatactgtgcacatagtgtatagacactatgtattcc

SEQ ID NO: 67426 - DNA, 663 bp, Homo sapiens
acgcaagtcaggtagggccttgtaggacactgtcaggatttggcttttaccaagagcaagatgagaagttgctagaaggttcggagcatagagtgatatgatctgacttcagttgaagaggaagctttgggactgctgtgttgagagtataccctgagagggcagacaatggaagcggctgaaagaccggttaggaagctcttgcaataatcctggtaagagatcatagttgcttgggccatgatgttagcaggggaggtgataagaagcagttggattccagaaatgttttaaagaatcgatatcacacagtttgctgatgaattagacattgaataagagaaagaaaaatcttaagaataaccttagaatgtttggcctgagctattgaaagtttggagttgccatcagtgtaagacaggaatcctgcaggtgaggctgactgggaaggaaagccttatagtttaaggtgtctacagatgttgcaagtagaaatgatgattaggcaattagatatatggacctggagttcagggaaaatgtatagcctgaagatacatatttaaaatttgtatgcgtttggttggtatttgaagccatgatactggaactagagaatgagtagcgacagaagaggattctctagactgaggcccagggtgg

SEQ ID NO: 67427 - DNA, 490 bp, Homo sapiens
gaacccctacattttgaaagacttgatattttgaagttaacgtttgggctttgaaaagtgaaaagtcatatttttatagttcaagaacatccctctctgccaccaaattcacacgagaaacataaaacttattttcctccatgttcaattttaagaattttgcccatcgaatactcatgcttcaaggaaacacactctctcatcaaaatctttcttactaaacaagcacctctgtcagaagtgtcttaatttcttatcacagaattttatccacacaaggagcaataaataattcatgtcactgcctctttgttgtgtgtccctgaactgcacagagctggaaggctgacagctgtgtcaggacaagcaccaaagatctgacatgacaagtgactaacaagtttctttcagttcacagtgaaagaagacaatggcccaaagtgcagaaagaaatcctaaaacaaaataaaactgcttctttctttttaac

SEQ ID NO: 67428 - DNA, 268 bp, Homo sapiens
ggcacgagggaaattgagagcaagagaaaaaaaagttaattatactgattttctcagattcatttcattgttgatgttgttagtcacagaccttaggtccccaggaagaagctctggagtgaggctgtgactacaatgtccttggggtctgccacttgatctgggggttatgtgggctcactccagagctagaagcatcgttcatttttgcctcaaaacaatgcccacatgtcagaagaactttcacaattcacaggaacagtgacct

SEQ ID NO: 67429 - DNA, 1369 bp, Homo sapiens
gggtactgaggaaaagctttgctgaaattggagatcaaataccagctctgccagtaagaagttgcatctcccagtgaaatgctgctgctgccatttcaactgttagctgttctctttcctggtggtaacagtgaacatgccttccaggggccgacctcctttcatgttatccagacctcgtcctttaccaatagtacctgggcacaaactcaaggctcaggctggttggatgatttgcagattcatggctgggatagcgactcaggcactgccatattcctgaagccttggtctaaaggtaactttagtgataaggaggttgctgagttagaggagatattccgagtctacatctttggattcgctcgagaagtacaagactttgccggtgatttccagatgaaatacccctttgagatccagggcatagcaggctgtgagctacattctggaggtgccatagtaagcttcctgaggggagctctaggaggattggatttcctgagtgtcaagaatgcttcatgtgtgccttccccagaaggtggcagcagggcacagaaattctgtgcactaatcatacaatatcaaggtatcatggaaactgtgagaattctcctctatgaaacctgcccccgatatctcttgggcgtcctcaatgcaggaaaagcagatctgcaaagacaagtgaagcctgaggcctggctgtccagtggccccagtcctggacctggccgtctgcagcttgtgtgccatgtctcaggattctacccaaagcccgtgtgggtgatgtggatgcggggtgagcaggagcagcagggcactcagctaggggacatcctgcccaatgctaactggacatggtatctccgagcaaccctggatgtggcagatggggaggcggctggcctgtcctgtcgggtgaagcacagcagtttagagggccaggacatcatcctctactggagaaaccccacctccattggctcaattgttttggcaataatagtgccttccttgctccttttgctatgccttgcattatggtatatgaggcgccggtcatatcagaatatcccatgagccatcatcatgtctcctctcccattcgcaataagtaccaagaagcccaagatatcagcccaaaagtcaatcttatcatatttcaaatgattttcaaatttgatgaaatcagagttttcatgtattttaaaataaattattatttaaacatcagcaaaaaagtacttaaaactgtaaatttattatgagactgtactaacagtgtgattcaccctgattttacacacattaaaatgttagaaaaaatgtgtctcaaaataaatgaaatataatacatatgacttaaaag

SEQ ID NO: 67430 - DNA, 1204 bp, Homo sapiens
gggtactgaggaaaagctttgctgaaattggagatcaaataccagctctgccagtaagaagttgcatctcccagtgaaatgctgctgctgccatttcaactgttagctgttctctttcctggtggtaacagtgaacatgccttccaggggccgacctcctttcatgttatccagacctcgtcctttaccaatagtacctgggcacaaactcaaggctcaggctggttggatgatttgcagattcatggctgggatagcgactcaggcactgccatattcctgaagccttggtctaaaggtaactttagtgataaggaggttgctgagttagaggagatattccgagtctacatctttggattcgctcgagaagtacaagactttgccggtgatttccagatgaaatacccctttgagatccagggcatagcaggctgtgagctacattctggaggtgccatagtaagcttcctgaggggagctctaggaggattggatttcctgagtgtcaagaatgcttcatgtgtgccttccccagaaggtggcagcagggcacagaaattctgtgcactaatcatacaatatcaaggtatcatggaaactgtgagaattctcctctatgaaacctgcccccgatatctcttgggcgtcctcaatgcaggaaaagcagatctgcaaagacaagtgaagcctgaggcctggctgtccagtggccccagtcctggacctggccgtctgcagcttgtgtgccatgtctcaggattctacccaaagcccgtgtgggtgatgtggatgcggggaaaccccacctccattggctcaattgttttggcaataatagtgccttccttgctccttttgctatgccttgcattatggtatatgaggcgccggtcatatcagaatatcccatgagccatcatcatgtctcctctcccattcgcaataagtaccaagaagcccaagatatcagcccaaaagtcaatcttatcatatttcaaatgattttcaaatttgatgaaatcagagttttcatgtattttaaaataaattattatttaaacatcagcaaaaaagtacttaaaactgtaaatttattatgagactgtactaacagtgtgattcaccctgattttacacacattaaaatgttagaaaaaatgtgtctcaaaataaatgaaatataatacatatgacttaaaag

SEQ ID NO: 67431 - DNA, 440 bp, Homo sapiens
aagtggaattgtaaatatttgtctttttgtgacttatttcatttagcgtaatatcctcattgtagcatatgaaagggcttccttccttttttgaaactgaacaatattccaccatatgcgtataacacattttgttcatccattcgtctatctatggacacttgggttgctttcacttttaactatcatgaataatattactatgagcatgggtgtacaaacatcttttatgtggagctcttttgttcttctgtttttaacaggtcatatcagaatatcccatgagccatcatcatgtctcctctcccattcgcaataagtaccaagaagcccaagatatcagcccaaaagtcaatcttatcatatttcaaatgattttcaaatttgatgaaatcagagttttcatgtattttaaaataaattattatttaaacatcagc

SEQ ID NO: 67432 - DNA, 282 bp, Homo sapiens
aagaggctcagggctgtgggaggcacatttttctctgaaaagcagtttggatgaggaagagatttggcagttggaagagagaagaagtcactacagggtactgaggaaaagctttgctgaaattggagatcaaataccagctctgccagtaagaagttgcatctcccagtgaaatgctgctgctgccatttcaactgttagctgttctctttcctggtggtaacagtgaacatggtaagagtcactctggcagctcccagcactggtgcaggggtttggatt

SEQ ID NO: 67433 - DNA, 440 bp, Homo sapiens
atgtatgcatctttgtttattaagtgatgggatttagcttaataatctagataaaaagcttttgccagatcaatatatgacaaatgttgatttccactttgttcttgcctttcagctctcctgaagctttttttttttatgaagagaaggttttaattctaataaagtccaatttgtcatatttttgtcttgataatttatgcattttgtgtcccaagaaatcttggcctgtgccaaagtcatggacatacttatctatgttatctactagaaatattgttttcaattttcaccttaaaatttaaaatccacttgtctcgaaatttgttaacaatataagataggtttatttctttctcacataaataaccagatgacccaaggctaattaccgagatgctgtcttctctccactgctcttctgtgcctgttttgtaata

SEQ ID NO: 67434 - DNA, 4408 bp, Homo sapiens
  misc_feature (1177)..(1177): n is a, c, g, or t
  misc_feature (1185)..(1185): n is a, c, g, or t
tgtttttgttgtgttatgtttccttgatttttcatgttccttggagttttgcattgctgccctcacatgtgaacaaggagtcacctcctccttcaatccttactaactgacttcaggatacaaagactttcattagtcagcctgacattctaggggtctcgcagacctttactatggatacacctgccccactcctcttgtttcctcttcaagaagaagctttatgtttgaatgtcttctcttgatcctgcaaagccaggctgggtgctgactgcctctcttttgtttttcctagggcattgccctgaagtactcaaagttaattgccttctcccagtcccagagagttaagccagatgtctgtgtgtgcttgtgcatgatttgcagaggctatgggtagggatggacagaagggcatgcagagtgcttggagacacatacgagaaagttaaatgggtccacaagtgttgcatcttttgatgttcatgggcagggttcatggagttcatgatgcaatgagtagaaacaatggccctttgtttagttctttactgaagttgctgtgagctctcaccccttttccctgttcttagctttcccaagactattcaactgagccagtttcttctgtgttatgggtgaagtgagataaaagtaggcctcttgggcaacattctgactagctatgctttcactttcccctgtgaaacaaatcgtgggccaagaatgtctctcttggcactgagctgtgtgctgccttgggaaaggggtgatgcaagtaaaatgaaactgttttccttaccctcttcaaggtaatcgtggatcatttttttctcccatggtgcgttgggacctctcccctggtccctgggctctacctaatatacttttgtctgtgggtagttgtcaaaattggtgttgctatggggataagaactgaaaactcttatcccaccatctttctaatgtcactcttctctgaatggattacattagaaaagaacaaggtgttcaccttctttaatgatgtagttacaaggaatctacctctgggagagacagttatgttttcataaatcctaaggcaaaacattagatatgaattctttttatttttatattttctttttctttttcaattctatctatctatctatctatctatctatctatctantctatctntctatctatctatctatctatctatctatctatctatctatctatctatctatctatctatctatctatctatctatctagtagagacagggtcttactgtgttgcccaggctggtctcaaactcctgggctcaagtgatcctcccacctcagcctcacaaaatgctgccaccatgctcagccagatatgagttctttttctaaaggaagggtttatttaaaaggagtcatagaccatcactggattctagtttcctgagagacatagagggtactctggcattgaagagagacactagaaggatggacatttttggaatgtttaacaagtctctcactttacagcatcagcagcagagagtgttaagcttgaaaaaataagaaaaaagtataaaattatgatcttagtgaattaatgacatattgccaagacttaggccatcatttatatattaacattaatgggatgtgaatgtttataataaaagacaaaaagatgagcttaaagaaattagacctattacccaaacataaatatttacttttacatgttgtcagagagtatttgtacctgtcatattgctgttttgcaaattagagagttaaattgactcctttttatagatattctatttccgtcctaaaactctttccatcactaaatctctcactaaactttgtggtgttacataatcctcactttctagttagtggcaatcataaaaacagataaaaaggctttcattattaggagtggcatggatgaagtagttgatactattggcaagatagaacatgacaaagagagcatgaccattatgacttatgcattaagtgaggtgttttgggctctttctggctatgcaccatatggtaaggaaatgatatctctgtcaggatagactagattgtaatgcagtaacaaatgaccctacttaaaaaaaattattgttatttgaatatttgcaaaatttaaggatcatgacatcatgatgaacatctatagaaatacatagctctctacctaagtacaaaatagagatatagagataaagtacaactgattcagatagttaaattattatgctattatttaatgttctcatgtgcagttttatgtattccagataatctttctaaataacttatgtagacatttatattttggtcagtctatttttttatttccaagtaatttaatttttgtcccaattgaattttaagaatagagctaaattaaaactgttactcagagctttttattcacttttatgttaataaagggttccttagagatgatatacctagttttctgtaagtggtttttattttcttggtaatctacaagtcagattttaggcaacacctgttgaaaaaaggttagggcaccatttacatgtttttcaaattgtaaagttctaatgcaggtttctgcagttagaatattcatgacacaaactgtttcaaatacaacttaaattgagattcaggtttaaatgttgatttatgaaagttcttctttaatgaaacttgtttttatgagatctctgaattgcaagaagtaggacttcagctttggaactgaaatagctcttggctatttgttttaatcactttccacacaaacctcacttctgaacggtcatcttatttagagttattatcaacttacttgccttagtgctgacattgttgatggattcgaagaagtgaaattggcaatcctgtatctaatgctagtgtctttggaacaacaaaaggagtttcaaagggaggctgaaattgaacacttaatattataaatcatgatatatgtatttttttgttttgtcttgtcttttactttggagaggggtttctttactgcatggacagttgtattcattaaatatatagaaaggtcatggctttcctaaaactttgggctgttctttaaaaattaatcttattctcatcaggagtttgtcacttctaaactgatctgagttaatttattggaactgtgagtaagagacattacataatttgggcacaaggagagaatctgtgtcctggaacttgctgatggcaccttcaaaggtgacccagttgaccagaaagtgttgatttccactttgtaattttaaaaatatatgacaatcaaagggcatttcatgacccaggagggagtggaagtagcaaataagcatgattattgcaaaagcttactagattgagtagaaggaatatgcactgctgtcaaaaagttgcaatgtaaaatagtcaaaactttttctatggctctgatgatagcaatcaacaaaatgaggaaaatgatgtggcaggattcagaatctgactaaggagtactaacagagaaaattatcatgttcttggctttagagacaaataaatgggccatgtgggcccaatcttttgtaacttaaaaaatgggaaaagctacgggagagttaacgttaccattttatgccttaagtgagatgttttgggctctttctggctacaaggtttggaaccacaattggattaatggtagttggctttaatggtccgtgggaagctaaaggttacaggcaatcatttcatcagcctcctggctggcctcaatggaaataaaattgtcagactgtaactttaaggaggctgagttagcaaatatattaatttcctattgttgttgttataaattattacaaatttagtggcttaaaacaacacaaatatattatgtcacggttctataagtcagaagttcaccatgggtctcactgggctaaatcaaggtatccacaggaggctgcaggaaacacgtttctttgccttttcaggcttctagaaactccgtgcattccttggctcatggcccctttttccatcttccaagtagcagtatagcattaccacaactacttcactgactctgcttctgtggtcatactgccttctctcgtctgtaacctgaccctcatgcatccctcttttcatttactgaaaaagcaatgactgtgacatgactaaataaagaaaatttatcatatttcttaaaataatgtatcaaaataattgtatttatcaaaatgacagcaaattaaaaatttaaaaagaaaacagataacaaatcaatacgcagggtatgaaattactccagatgaaatgaatggacaagtgattagaaaataattatattcatggttgctcaagatataaagagatagcagttact

SEQ ID NO: 67435 - DNA, 356 bp, Homo sapiens
ctgcactccagcctgggtgacagagtgagactccatctcaaaaaaaaaaaaaaaaaaaaaaaaaaagtttcttcctttctaacaggaacctgggggatccacctgtgtgacttagctatgaaatgctcccctgggactgaacaagttggctttctgagtggaaggaccagcattggctatgttcttgttggacagtaccaaccaaggtctcccacagatgctggtgttggcagaggtttcgccgtgctgtttgcacagcttgtgttggattctaggtcaattgcttcttccaggctggagtgcagtggcgcaatcttggctcactgcaagctccgcctcccaggttcacgccattc

SEQ ID NO: 67436 - DNA, 892 bp, Homo sapiens
tgagacctactgcattgataacgaagctctctacgacatttgcttcagaaccctaaagctgaccacgcccacctatggtgacctgaaccacctggtgtctgctaccatgagtggggtcaccacctgcctgcgcttcccaggccagctcaatgctgacctgcggaagctggctgtgaacatggtcccgtttccccggctgcacttcttcatgcccggctttgccccactgaccagccggggcagccagcagtaccgggcgctgaccgtgcccgagctcacccagcagatgtttgatgccaagaacatgatggctgcctgcgacccccgccatggccgctacctgacggttgccgccgttttcaggggtcgcatgcccatgagggaggtggatgaacaaatgttcaacattcaagataagaacagcagctactttgctgactggttccccaacaacgtaaaaacagccgtctgtgacatcccactccgggggctaaaaatgtcagccaccttcattgggaataatacggccatccaggaactcttcacatgtgtctcagagcagtttacagcaatgttcaggcgcaaggccttcctccactggtacacaggcgagggcatggatgagatggaattcaccgaggccgagagcaacatgaacgacctggtgtctgaatatcagcaatatcaggatgccacggccgaggaggaggaggatgaggagtatgccgaggaggaggtggcctagaactctccttttctaggtaaaggggggaagcagtgtggattctttactgtgttctgacagccatgtgtcactatacgcttgttaatttgtgtcttcacatctcctgctgcgttttaaagcatttttatagtatgcggttttgactaa

SEQ ID NO: 67437 - DNA, 196 bp, Homo sapiens
agccaccgtgcccggccccagagagattttctaacctgaaaagggtgcgtacaaaattatcaagcactggggataatgtggggcacccactatggaacttgggaaatgggtgtgaccactttggaaacaatttggcagcaccttgtaaagttaaaaatgtgcataccttcagacccaacaaccccactcccaggca

SEQ ID NO: 67438 - DNA, 620 bp, Homo sapiens
ggcctggtgcccaagtgtctgattcagtgggttggtccttaggactggcatttctaacaagttcccaggtgaggtgaggctgatgctgtggtctgggaacacattttgagactccagcccctagcctggtaacacctggggttttgacgcagaagtgccacgttccacgcttggcacatagtaattgatttcattctaacgctagccgacttcatgtattgaatagtttcccatctcagtgtctaagaagctccacagctggagatggcggcccttggtctcggagcccccctccttgtgatttctgctttgtgattgctttgatgaaccatttgggtccaggtgctcctgatcacaccacctcccctatttgggacttgtgccccactcccgctgtgagggctacaccgagctctgggggcctgttcggattaacaaggagatcttgctaaaggtatcttggtgctaagttaagggagatagttcgccatgggctaggatctctcagtgctggtgaccttgggtgagtgtctccctgtaaagtgataaggatgcctgctggaaagggtggtgggaggattaagtgcgttaaagaggccctcctcccaagcttttagttg

SEQ ID NO: 67439 - DNA, 948 bp, Homo sapiens
tgagaaagatgtgtaaatacaggacgataaaggaatgtgccagggcgacagagcgagactccatctcaaaaacaaaaacaaaaacaaaacaaaacaaaacaaaacagactttttgtaccagagctctaagagttaaaaatttcaggcaaattacccataaaaatcccgatggtggaagggtggaacaagagaacttgggtcaccacacaactctatgacagtcattgtagatggtatgcacagagtttgttgtgacacagcaaccctgataagtatacaagaaatgaaagccttagctaaatgtttctttataggattgcaatttctagttttatttaataaacacagttataagaaccaatgcagcactgaacaggacaagagataaatgagcctgtctctgagtatgcatcacaccctataccatgtttagttcagaacagccaaggttagcaacctcctccttcaaatatcacaattctatgtgcatccatcactcagcagcaataacgtttcttattgcttctaaaggcaatgccatacacttggaaagctgtaatttcactgcaacacatacatgcacactacacacaaacacatttatatgctctctcgccagtctggtgagcagcaatccttgactcaagtcttcagtctgcaccttcgaaagtaccagaaatgtccctttaggaagacagttcagatttactttcattacatgttcccctccttgtattccagggcaagagaggaaagataatagaaaagatattgaaggcccacattaaatcaacccaacttacatttagtatgtgcagtacacatttaaattatgctgtaacagagatttctactgctacaacacaacttgtttccttttttctggatgacacagataaagtgaatttttcaaaccctctcagggcaatgtatgtgtggcaaaaaaaa

SEQ ID NO: 67440 - DNA, 226 bp, Homo sapiens
gaggatgtattcctaatgaactttaaagatcctaaaaatccagttgtatatggagtgtttacgacttccagtaacattttcaagggatcagccgtgtgtatgtatagcatgagtgatgtgagaagggtgttccttggtccatatgcccacagggatggacccaactatcaatgggtgccttatcaaggaagagtcccctatccacggccaggaactgtaagtagct

SEQ ID NO: 67441 - DNA, 4625 bp, Homo sapiens
  misc_feature (391)..(391): n is a, c, g, or t
  misc_feature (776)..(776): n is a, c, g, or t
  misc_feature (1588)..(1588): n is a, c, g, or t
  misc_feature (1685)..(1686): n is a, c, g, or t
  misc_feature (3346)..(3346): n is a, c, g, or t
  misc_feature (4623)..(4623): n is a, c, g, or t
cctgtctcccggacgaggacctcaaccccttcccccgctcggggaccccggccacccgcagcccggccgcgctgcgcccagaaacccatgagtcttcctcagcagctgtcgaaacttgccggcggttgcttgctcacctttgctgtctccccttcagaaaaggctggaggggagggcgaggaaggcttggcgtggggacgcccgtcgagtctctcagtgaggaatgagaggccagcttctcctgcggggtatgaaggaggaactgtatctcctatatatattaagtttcatttataaagacatcagagagcacctgagaatgtttcaaggtcaccaaaagctttctgaaaatgcctttctgcaaagaaggtttccagagatagaagataantcaggaagcttagaagaggtcaacctgggaagacaggattctttctccccacccgtggctctgcaggaagcaataccctcccctctgggcaaggtcgaccctccaagtccagatgagaagagttccctctgtctgctctttcctctgcctgatgacccagaggctttgcagctgtgatcctggcagcccctggccacctcagggagctgcagaattcaaaccctggaaatggagctctgcttgcagctgcacctggggcctgacctgcttaggacaggcctgtctggacctaagagaaccccactgccacccactcagctactccctaacagactgcagagaccaagtctttttcatttctttatatccattgatttctcgagtnattgaaactcaatatttactgagcacctacaatgtgccaggcactgtgataggcactgaagaaagggcaaaggacgagcagataaatttcctacttgcagggaacaccgtggtagtgagtaaaatgagacattgcaaataaacacataaatatataatatgtcaactggcaataattgatgcgaagaatgattaagcaaaacaaggaaatgcagagacagggaaggagcatctatctggtatgaagtagtcagagaaggcctctctggtcagatgacatttgggcagaacctggggcctgtctcagcaccacctgttccttcctcggccacttgctccctgcagccaccaaaggcccctgtggttttcccgcctgaggctcaccagccacaggcctagaatatctggcttctctccccacgtccaaactcagctgaaatgccaaactgcaggaccttgtttcctgagcaactgccaatggggctgaatgatgcaactcggaaaggaagaggatttcattccccctgaatggactttgcaccagtgggagacaggaaacaggagattggaggatactgggcagctgaactgcctcaccctttccccctgccccgtctggtgcacaatttctccacacagcctgctgtgtgtggccaagcctgtgcgccgactgagtgttatgggttgaactatgttcctcagaaagatatgtcgaagtcctaacccccagtaactgtgaatgtggctttatagtatttggaaacagggtctttgctgatgcaatcaagttaagatgaagtcattaagggggtnggggcctaatccaatctcttgtccttagaaggagaaagacagagacacatcaggggaagatggtgaggtgacaatggaggcagagattggagcaatnnatctaaatgctaggcaacgccacagagagctgcaaacaccaaggctagaagaggcagggaaggagcctcccctacaggtttcagagggagcatggcctcaccatacctttacttcagacttctagcatccagaactgtgacacaacacatttctgttgttctgagtgacaacagtgtgtggtgtgttattacagctgctctagaaactaacatatcgagcagccagctgtgtgggattgtacctcccaagtaaccctctaagacttaacctttgcccagggctctgtctctagagaactgtgacaatgataggtagacctgaataaagcgaaggatgatatctgcagggatatttgaggacagggagtgctgacaagggaggagccagtgcaaaggccccgaggtggcagtatgcttggtgtgttggaggagcaggaaggtgaccagggtgtttggggagtgaataaggggaagagtgctcagaggagaagtcagaggaggggccaaagacatgttctctagggccagaaaggcctttggatcttttcgacattatcttcttgacatgtaatttatatagtagtaaaatgaacaaaatgggtgactattttgtgaattttttagatacataaaaccacgtgatcactatccagatcaaatgttgaacatttccatcaccccagagagttcactcctgctaccttccagtcaatacaacttaccaatcctgaggcaaccagtactctctcttttatcatcataaatttgttttaacctgttccttaatggcatataaatgaaactacatagcatgcttttgctcaaaatagtgcttgtgaggttcatccaggttgctgtatgtatacttcaattattattattgctgagtagtattccattgcctggatatatcacaaattatttatccattcttctgctgaatatttgagttatttgcagtttaggcctataataaatgaagccgctaggaacatttatgtgttcctcttattttggttgcatgcaatcatttctcttggtataaacctagcagtgtattttctgggtcaactggcttaggtttaggttaactgtattcgtttacaccattttatactcccgtcagcaatatatgagttccaggtattctgcatcctcaccaacacttggagcctttctggtaggtgtgtagtggcattgcattgtgctttcaatatgcatttttctgctgactaatgcactcctttttatatgcctattattcacatatctccttttatgaagtaggtattcaagtcttttattcacattttatgttttgttatggccacatctcacttccagaatctgtattggttatctatcgcgcattaaaaaagtactctaaagcttgacagctaaaaacaacaaacattcattctctcacacagtctctgcaggtcaggaacctgggtgcagcttcatggggtggttctggctcagggtctcaggttgcatttgagctgctgtctgaggttacagccctacctatcaaagctgaaccagagccagactccatgtctaaactcacttatgtgagcttcagtgtgagaaatgtatgaattttgtttgatgaaatattgaaaagcttaacaacttcctcctactctcattggcctcntggtgcccagtatctgagtctgaaaaatctcatctataggaatcaatggcagcaaagacagaaccaaggtcccacggctattggggaggttggcagatgagtgaggaaaaaggggtgtcagcaatctaaaaatattcaggctcacagaaatataactgtttgaaatgactcacttttattaagatcctgccatctcacttaccagcttaaaaaaaaatagatcacagcagaatgtttcaaattctccataaatggccatttgatccagcaacctacctgtggaaatttatgccaagattagaatctacaaaatacatacagagatgcacattgaagtattatttattaggaatctaaattgtggaatcattaaagagaatacatattccctcaaaagaataccatggtgttattaaaagtagtcattatgagtggttaggatataatataatattacaggaaattcttaggatataccatcaagtagaaaaacttttcttcccagcttttcaatgtgaaaatgtttaaacctacaggaaagttgtaaggccagaacaataaatgcttgtatagccttcatctagattctccaacagtgaccacagttgccacatctctttaagtgtaatgctcatcctttgagagtaagtgcagacattttgataccatgctctaagtactacaacacctatctaaaattgtagaaggaaactcttctatgattttcacactcaagacatttaacactgatataaagtttatattcaaatttctccaaaagatttaaaactatctctttggcttgtgttatccaggactcaatggaggattgagcattgcatttagttgttgtgcctctttagttttttttgatctaaaacaatccctcaaccatttttaaaaattctttcatgacattgacatttttaaaagactctggaacagtcattttacagaatatccttcaatttggatgtgtctgtttcctcaagattagaaattacatgaacttcttggctaacttctccattttattttgtgttcaaaatatattactctttcccatgtcctgtgaaaataaaaaatctctaatgtgtttgtgaaaaagattaagctaagattttgtttggatgcagtgtgatttggacttaggtgtgtgtatctgaacttcatcctttgtcatcaaaagaatagtataataactaagaacatgtagcttaagaaatccaggcacttgagagccactgtaagtaaactctaattcccacagcagaaanaa

SEQ ID NO: 67442 - DNA, 457 bp, Homo sapiens
cagccggcctgtggatgaggcggcggaaaccacatcctcttcatcatcctctcacgaggaaggacactgacagcttcggagaaggctgcccagtgtctgcgggtgcccttgggagatggccttgggacacggtgcctgtgcctgtgtgtgtacaccacgtgtgaacgccaactgggaacacggccccttcgtaggcaaacccaggcctcctggaagtcacaagttgatagctgtactcgccccttttggaagacgcacgcccaaggcacccgtgtgtgcacacgtatccgtgtgtggacctctgtccacacgtgtgtgttttgaaaagcctttctcaccacatgttaggatcacaagtgttcaaaatctaggcacacttttcagaagttatttctggaaaaaatgttgaatctcataacagcaataaaaggaaaataccgcctcagccaacaaaaaa

SEQ ID NO: 67443 - DNA, 775 bp, Homo sapiens
ctctctgggaagagtgttccagacggaggagagggcagatacagagaaagcatggggtgggaggatttggcgtgtttgaggccacaagcaggcagtgtagctagagaggggactgagatgaagttcaagggataattagcaccacagtgttggaagaagttcgaagtgtattataagtgtagtaggaagccattaataggtgttgaacaggggaatgatggaatctgagttcaattctcaaaagaccactctggccctaccattgtctcaagcgctcaagctgtagacctggaagacccccatcctgtcagtcgtaaactctccagtcttcatttgaaagatcttttgaatccatgtgtttctcaccaccctgcccctgatcctctagtcaggacctccatcatctcttgccagtggtacagcagtagcccctgagctggcctctccccctttcgttcttccaggcacatgtaccactttcttgctctgcagtgttgttttctgcctgttgatgttgtgtcctttcacaggtcaaggttaaaagtcacctcctctgtgaagtctttactggctccaccccagccccctgtaactgcttttttaaactgcgtctctggaggcttggcctgcacccctagccaggtgctttatgctcgtgcccaggcagcattgaggccaggactcggccactggccctgtgagttctccttaaactggatcagtctctccagcacccaggtcctgtagggccatggttctcagaacacagacaggt

SEQ ID NO: 67444 - DNA, 233 bp, Homo sapiens
tgcatatagatatccaatgttccagcgtcactgttgaaaagtttcctttctctactttcacttttgcaccaacctaataaatgaaaaagggctttgtgcctttgtcacacatcattttctcatatgtacatgggtctatttctagattctctattctgggaagaaatatactgattactgaaacttattgtggaatgcataaaaaattaagacggattggtggataaaaaaga

SEQ ID NO: 67445 - DNA, 1494 bp, Homo sapiens
ggtgggaatggcaggctgcgtcccactgctccagggcctggtcctggtcctcgccctccatcgtgtggagccctcagtatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagagaagtgtttgaaaatgaagtagtcactgatgaattctggagacgatataagggcggctccccgtgcatctcccagccctgcctccacaacggctcttgccaggacagcatctggggctacacctgcacctgctcccccggctatgagggcagcaactgcgagctggctaaaaatgaatgtcacccagagcggactgatgggtgtcaacacttctgcctcccaggacaggaatcctacacgtgcagctgtgctcagggctacaggcttggtgaggaccacaaacagtgtgtgccccacgaccagtgtgcctgcggggtgctgacctctgagaagcgtgcaccggatctacaggacctcccgtggcaggtaaagttaacaaattccgaaggaaaagacttctgtggtggtgttataatacgggaaaattttgtactgacaacagcaaaatgttcactgttacacaggaatattactgtaaaaacatattttaacagaacgagccaagacccgctgatgatcaagataacgcacgtccatgtgcacatgcggtatgacgcggacgcgggggagaatgacctgtcactgctggagctggagtggcccatccagtgcccaggtgcggggctccccgtgtgcacccctgagaaagacttcgctgagcacctcctcatcccacgcaccaggggcctcctcagcggctgggcacgcaatggcactgacctgggcaactcgctgaccacgcggcctgtcacacttgtggagggggaggagtgcgggcaggtcctgaatgtgactgtcaccaccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaaccggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcataaaaaaacc

SEQ ID NO: 67446 - DNA, 1606 bp, Homo sapiens
ggtgggaatggcaggctgcgtcccactgctccagggcctggtcctggtcctcgccctccatcgtgtggagccctcagtatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagagaagtgtttgaaaatgaagtagtcactgatgaattctggagacgatataagggcggctccccgtgcatctcccagccctgcctccacaacggctcttgccaggacagcatctggggctacacctgcacctgctcccccggctatgagggcagcaactgcgagctggctaaaaatgaatgtcacccagagcggactgatgggtgtcaacacttctgcctcccaggacaggaatcctacacgtgcagctgtgctcagggctacaggcttggtgaggaccacaaacagtgtgtgccccacgaccagtgtgcctgcggggtgctgacctctgagaagcgtgcaccggatctacaggacctcccgtggcaggcctctaacacaattatctcctgcctgagttgaggtgcagccctcgtgtccacaatgctccgtacccgagtgtggctgccgtgtggatggcacagcctcaggggccccccttgtaaagttaacaaattccgaaggaaaagacttctgtggtggtgttataatacgggaaaattttgtactgacaacagcaaaatgttcactgttacacaggaatattactgtaaaaacatattttaacagaacgagccaagacccgctgatgatcaagataacgcacgtccatgtgcacatgcggtatgacgcggacgcgggggagaatgacctgtcactgctggagctggagtggcccatccagtgcccaggtgcggggctccccgtgtgcacccctgagaaagacttcgctgagcacctcctcatcccacgcaccaggggcctcctcagcggctgggcacgcaatggcactgacctgggcaactcgctgaccacgcggcctgtcacacttgtggagggggaggagtgcgggcaggtcctgaatgtgactgtcaccaccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaaccggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcataaaaaaacc

SEQ ID NO: 67447 - DNA, 197 bp, Homo sapiens
tgatttttattctcatgttgctgccgcaaatgcagaccagtgtgcctgcggggtgctgacctctgagaagcgtgcaccggatctacaggacctcccgtggcaggtaacagagcgctctccgcgtgcttcaatttattgttatgactttcacctcacttgtcatttcctaaatagaaatgttgacaactaagtgaatc

SEQ ID NO: 67448 - DNA, 1560 bp, Homo sapiens
ggtgggaatggcaggctgcgtcccactgctccagggcctggtcctggtcctcgccctccatcgtgtggagccctcagccacttcactgaaggaacgacatggactccattctgactctgcctgcacaggcgtccaggaaagcttatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagagaagtgtttgaaaatgaagtagtcactgatgaattctggagacgatataagggcggctccccgtgcatctcccagccctgcctccacaacggctcttgccaggacagcatctggggctacacctgcacctgctcccccggctatgagggcagcaactgcgagctggctaaaaatgaatgtcacccagagcggactgatgggtgtcaacacttctgcctcccaggacaggaatcctacacgtgcagctgtgctcagggctacaggcttggtgaggaccacaaacagtgtgtgccccacgaccagtgtgcctgcggggtgctgacctctgagaagcgtgcaccggatctacaggacctcccgtggcaggtaaagttaacaaattccgaaggaaaagacttctgtggtggtgttataatacgggaaaattttgtactgacaacagcaaaatgttcactgttacacaggaatattactgtaaaaacatattttaacagaacgagccaagacccgctgatgatcaagataacgcacgtccatgtgcacatgcggtatgacgcggacgcgggggagaatgacctgtcactgctggagctggagtggcccatccagtgcccaggtgcggggctccccgtgtgcacccctgagaaagacttcgctgagcacctcctcatcccacgcaccaggggcctcctcagcggctgggcacgcaatggcactgacctgggcaactcgctgaccacgcggcctgtcacacttgtggagggggaggagtgcgggcaggtcctgaatgtgactgtcaccaccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaaccggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcataaaaaaacc

SEQ ID NO: 67449 - DNA, 1369 bp, Homo sapiens
ggtgggaatggcaggctgcgtcccactgctccagggcctggtcctggtcctcgccctccatcgtgtggagccctcagtatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagagaagtgtttgaaaatgaagtagtcactgatgaattctggagacgatataagggcggctccccgtgcatctcccagccctgcctccacaacggctcttgccaggacagcatctggggctacacctgcacctgctcccccggctatgagggcagcaactgcgagctggctaaaaatgaatgtcacccagagcggactgatgggtgtcaacacttctgcctcccaggacaggaatcctacacgtgcagctgtgctcagggctacaggcttggtgaggaccacaaacagtgtgtgccccacgaccagtgtgcctgcggggtgctgacctctgagaagcgtgcaccggatctacaggacctcccgtggcaggcctctaacacaattatctcctgcctgagttgaggtgcagccctcgtgtccacaatgctccgtacccgagtgtggctgccgtgtggatggcacagcctcaggggccccccttgtaaagttaacaaattccgaaggaaaagacttctgtggtggtgttataatacgggaaaattttgtactgacaacagcaaaatgttcactgttacacaggaatattactgtaaaaacatgtccatgtgcacatgcggtatgacgcggacgcgggggagaatgacctgtcactgctggagctggagtggcccatccagtgcccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaaccggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcataaaaaaacc

SEQ ID NO: 67450 - DNA, 895 bp, Homo sapiens
gtttcatgtctttcctcaactggctcacatttctagaaaggtgataagatgaagcacaaagtgctgggattacaggcatgaccaaatgtgctcctttaccaattgtttctgtctcaggaattggtttcttgttgcactgtgatacacatgaagccatatacctttttcagctcattatccccagaatgtatttgtacattattaacacagaatagacacctaataaatatttctaaatttttattgttcttccttgccacaaaacagcaatcacttttttttagcatgatgtacatgcccttctatcatcttgccctgaactatttatcaaatcttatttcttcccactcccccatttgtttcccgtgctgtggctgtacagaactacttagagctctgtcaactctccatgctattttataataatcaacactaatgaaaagaaagggggctttataacagaggcagaactcattatgttctaaaaaatacacgcatgtttcccatgttgaatagtgtcccgcagaaagtcatgtccagctggaacccaggaatgttaaactatttggaaacagggtctctgcagataacacttagttaagacaaggtcacaatgcattagggtgggctgtaaagccaatggctgtgtcctttcaggaaggtcgtgggaacatacagagacctacagggaagacggccatgggacaagggaggcagagtctggagttacgctgcctacagtcacggaatgccaaggacagctggaaaccaccagaagctaagaaggagattttacctgaaagcctctcaaagaaatcaatcatactcacacctcctttttgaatttctggcctcgtgaatggtgaaaaaataaatttctgtcgtcttaagcccc

SEQ ID NO: 67451 - DNA, 470 bp, Homo sapiens
cacagaatcttgctctatctcccaggctggactgcagtggtgcgatcttggctcactgcaacctctacttcccaggttaagcgatttctcctgtctcagcctcctgagtagctgggattacaggcgtgtgccaccacgcctagccaatttttgtatttttagtagaaacagggtttcaccatgttggccaggctgatcttaaactcctgcaggaaatccacctgcctcggcctcccagagtgttaggattacaggcatgagccaccacgcctggccgggcagggactctttcttacggagcaccttacacttagtaagtgttgggtaagtatttgtttagtggttcaaataatgtttttatagaaagattgcagttttgatccttccaaagaacatctgttgttgaggtttttctaatagaagtaataattcactttaatctatttatacattttcttcctgtctgtatt

SEQ ID NO: 67452 - DNA, 315 bp, Homo sapiens
cctcccaaagttctgggattacaggtgtgagtcactgtgcctggccttaatccactatcaatgtgtattttgaaatcaccaagagttctggacaagagaggtattggagagggtgacagtgagctagggataaaccaaaggggagtgatgaggggcttggtagatgactgtgatgaagatgagtagaaggctgtggagtctaatgcttgtgcctcagaggagctgggggtggggggttcctgaggagagagggaccatggtctgggaggagtgcatgaagtgcatggaggacacttatgcctctggaatcactgt

SEQ ID NO: 67453 - DNA, 189 bp, Homo sapiens
ttgcctgtaatattcttcttcccttgattaaaagcatggggttctgaagttaaacaaacctgggttcaaatccaagctccattcacttaataaccatccagctttaattaatttctctaagactcttttctcatccataaaatgggtatattaactgcattcagctagtaggtaggttaaacgtggtag

SEQ ID NO: 67454 - DNA, 413 bp, Homo sapiens
gacataactaaatgagagaaaatccaatgatttaggcattttaaaagcaaaatagaaagggtttgggagaaaaggaattttactcttcagattaatacattcactcctaagctttagcattgttataaaacaaaagatggctgggagcagtggctcacacctgtaattccagaactttgggaggccaaggtgggaggatcacttgaggccaggagttcaagaccagcctgagcaacatagcaagtccccatctctacaaaaaatacataaaatggcccagcatggtggtgcatacctgtagtcccagttactcagggggctgaggtgggaggaacacttgaaccctggagtctgaggttgcagtgagctgtgattgtgcctccagcctgggtgacagagcaagaccctgtctc

SEQ ID NO: 67455 - DNA, 567 bp, Homo sapiens
aaggacaagaatccttcaaaaaacaggaaaaaactcgtaaaacaccaaaagggcctagttctgtagaagacattaaatcaaaaatgcaagcaagtatagaaaaaggtggttctcttcccaaagtggaagccaagttcatcaattatgtgaagaattgcttccggacaactgaccaggagactattcaagatcctggcagtggaggaagtctctttagaaaatagtttaaacaatttgttaacatttttccatcttatttcatttctctaacagtcaatatctggctgtcctttctataatgcagagtgagaactttccctactgtgtttaataaatgttgtccaggttccattgccaagaatgtgttgtccaaaatgcctgtttcattattaaagatggaacttcaccctttgcttggttttaaatatgtatggaatgttatgataggacatagtagtagcagtggtcagaacatggaaatggtggggagacaaaaatatacatgtgaactaaaacttggcattttaataaagtagcatggtttctattgaaaaaaaagattacgac

SEQ ID NO: 67456 - DNA, 439 bp, Homo sapiens
tattgagagtatttctttcatgttgaaatcaagcaactttcttggtaaaattctatttcttaacgcagtcagtaattggtgggtgaggtgaccacatgccctgaggaggcaggtaggcccatctagagcaggagctgggctcatgcagatggatctttgaccctacctctgttcctcatagttggatgaccctggccaactcacttcaccctgttactttccttatctgcaaaattcatgtctccaaaattcccttgtggggttgctgtgaggatgagttgaaatgatgtgtgtggtgtcacagcatgatttccttgatccatggaagttattaagttgttggcagtccacttcttgcttttgtggagttgtatttttgttctagctcttttgttcacagacggggtgactatgtaatttatcatccaaactgggaatt

SEQ ID NO: 67457 - DNA, 530 bp, Homo sapiens
tgcaacctctgtctcctgggttcaagcgattttcctgcctcagcctcccaagtagctgggattacaggcatgcgtcatcatacctagctaatttgtcccatagaatctcatcttctggattttgtggctattttttcatggtgttgattcattcataaggtaaaatttatatacagtgaaatgcattttatgggtacaattcaatgagttttgaaaagtgtgcacatccatgtaaccaccacccagattaagacacagaacattcccgtcacctcagaatgtttcccggtgccttcttcctacccctcatacagtaacattgtaataatttctattgccacatatatgtttacctgttctgaaacttcacagaaatggaattatatattatgtatttgtttgttactggctttttatcatttaatttttttttattcatccacacccactgcatgtgtcagtatttcattccttcttgttattgtgtagtatacgaatatataaatatatcactatttttgcaatctcct

SEQ ID NO: 67458 - DNA, 550 bp, Homo sapiens
cttctgctcatcagaagatcttattagatttaaaaatagccaggatccgtggctcatgcccatcctcccaagtagctgggattacaggcatgcgtcatcatacctagctaatttgtcccatagaatctcatcttctggattttgtggctattttttcatggtgttgattcattcataaggtaaaatttatatacagtgaaatgcattttatgggtacaattcaatgagttttgaaaagtgtgcacatccatgtaaccaccacccagattaagacacagaacattcccgtcacctcagaatgtttcccggtgccttcttcctacccctcatacagtaacattgtaataatttctattgccacatatatgtttacctgttctgaaacttcacagaaatggaattatatattatgtatttgtttgttactggctttttatcatttaatttttttttattcatccacacccactgcatgtgtcagtatttcattccttcttgttattgtgtagtatacgaatatataaatatatcactatttttgcaatctcct

SEQ ID NO: 67459 - DNA, 2260 bp, Homo sapiens
gatgaagtgctttctgggggcagagcactttcatgtatcatcttactgagtcactacaatcctcactctgtgaggtgatgatatattagccccattacacagaggagaagggctcagaaaagttcttagctcacctgaagtcacacagctaaaagtggcaaagatgggctttggatttttaatccaagtcagtcttgacagaaaagcccatggcctgtataccatatacaacaagttgcctctcttacaattctccttcctcaggctgggtgcgctggctcacacctgtaatcccagcactttgggaggctgaggcaggcagattacctgaggtcaggagtttgagagcagcctggccaacatggtgaaactccgtctctactaaaaatacaaaaattcgccaggcgtggtggtgggcgcctgtagtcccagctacttgggaagctgaggcaggagaattactggaacccgggaggcggaggctgcacagtgagccaagattgcaccactgcactccaggctgggcaacagagtgtgactccgtctcaaaaaaacaaaaacaaaaacaacttctccctcctccacagactcctccctggtcaccactagtgatccaccttatggatctcccaaggccacctctgcctctgctctgtgttgtattatttggggacctgtggtctggcatgcattgtacttggtgccccaaagggctgtggcatctgataagtgatttatcctcaggcacagatttgcactatgtcaccactacttgtatgtagaagtgagtcaccggctggcaaatgggcatagctgctgggcagtggatgcagctccatgcatgttattctcatttgatacaggatctcattggcttctcacagcaatcctgtgcactataggtattgctcccgggaacagatgaggaaacaggagagtgcgagattacagtaattttgtaaatgggaggatttgtgaaggtttcagacatacaccctctctcatatgtcaaggatatgaagtctaatgaatcccctaaagcagcaggggttggcaagctgtggccctggggccaaatcagcctactgcctgtttttgtaaataaagttttattggaacacagtcacacccatcatcaatgtattatctagggctgctttctgttcattggtagtttgttgagtagccacagcagagacaggcttgcaaagtgaaaatactatctggccctttacagaaaaaaagggtcagtgtccctgctctaaagaagtatgtgtgaggtgccctggccacttatgggaagaaaagctgagcctattcagcaaggttttaggtggctcagattttatagaggaacaaacattgagctggcctgggaaggatgagcagaaggtcgtcgagtgtgttgggggctgggggactctacgcagtgggagctccttacatacaggcatgagaaagcctggtgtgcccctcagagtgtcatggagcctatggtaggagaatacggtgcataggaaagagtgaaggtaggagagtctgcatgctagatgggccaggcctgggatttctgtagtctagtgtgtcaggcagaggctctcaagctgggcttcatgacacaatgacctgtggaatgctcaaaaaatacatattcccaggctcctggctactgaattagaagagtcaggagaatgccctttaatctgctttttaaaccatgccccagataattctaatacaacaaattggaaggcctgatgagaccccactcagggaagggagggagggaggctggagactggagaccgctgccagggagcagggaggggcagtgggatcaggagggaaggcagggttggcagtgtcacttggacagggccaccatgccccaatcttgtatctcccacggcaccttgcacatagcatgtgtttactaggtatttattcaccaagtaaaataaggattctttgttcttgcatgttaaggagtgacacccaaaacacctgtaaaaagccagcagagggtaacattttaggcattttgggccacatgagttgtctgtctgttccatattcttttcttgttttttctttttctttttttcttgagacagggtctcgctctgtcacctgggctggagtacagtggcacaatctcggctcactgcaacctctgcctcccaggttcaagcgattctcctacctcagccaccatccccgcccccatcccagtaactgggaccacaggtgcgtgccaccg

SEQ ID NO: 67460 - DNA, 502 bp, Homo sapiens
ttctactttgaatatatgctgattctgttattgtgcttttcagtatcttagttgtggaagcatttgaaaatggcttgattctgtggacaccagagaaacctaagttatacttagatttaaaattgaccttttttttaagaaaaaatactcactgacaaaatgattttttaaaaattacagttgaagcatttaaaaaatataaacgttaaaatgtaatatcccagctgggtgcggtgactcacacctgtaatcccagcactttgggaggccgaggtaggcagatcacttgagcccaggagtttgagaccagcctggccaacgtggcgaaacctcatctctactaaaaatacaaaaattagctgggtgtggtgcacgcctgtaatcccagctacttgggaggctgaggtttgagaaccacttgaacccgggaggcagaggttgcagtaagccaagatcacaccactgcactccagcctgggcaacagagcaagactctgtctca

SEQ ID NO: 67461 - DNA, 690 bp, Homo sapiens
ctctgctgtttgtcctggaccctgccaagagagggaatttttacatattgatgagctcagcagccaggaatcaaatccgagttcgtctacagctgattcggcaggtaccagggcgtccgcgatggtgagtgatagcaccgcgatggtggtattgctccatatgcctgagaccctaacaaaagcctaattacaactcatatgcctggagccaggacatgtgcaggatgactctgccaagagaggggattattacatattgcagagcccagcacctaggtggagtgactctcatctttttcttctaccccgtatatagccagcttggtgacctactatttgaggctatacccaggcccagaccacagatgaaattgtgcaatatgtggaacaaacacctaaacaatatataacaccttccttggctctgtctacaaagggcacttttatatatcactgggaccatcaaccaggtgatgttaattatcttcctgaaacctgtctacaaagagagttgtgtcgtatacctaggcccgtcatgtaagtgatgtcagtcccttctactgccttggccctgcacttacagtgcattgtgacacataacaaggtactgcacacagacgatgtgattctcctttttgggttctgccaaaaggaagcattgtaataaatcgcttggctcagtaaaaaagt

SEQ ID NO: 67462 - DNA, 818 bp, Homo sapiens
atcccctctcctgcttaagtccttcccacagagagcggtttgatatgtcactgaaaccagcatccaggtggtattgctccatatgcctgagaccctaacaaaagcctaattacaactcatatgcctggagccaggacatgtgcaggatggtgatgtaactttcctctctggaatgggtcctgcacaaaggaatgatagtaacatattgcaaagccagacacacagccatgatggtccaagttatattgggattcagccaatagaagatattttgcctgtcatccctaagcttaggacaatagggtcctgcccacaagaaagattgtgacatctcactggacaagcacccacccagactctgccaagagaggggattattacatattgcagagcccagcacctaggtggagtgactctcatctttttcttctaccccgtatatagccagcttggtgacctactatttgaggctatacccaggcccagaccacagatgaaattgtgcaatatgtggaacaaacacctaaacaatatataacaccttccttggctctgtctacaaagggcacttttatatatcactgggaccatcaaccaggtgatgttaattatcttcctgaaacctgtctacaaagagagttgtgtcgtatacctaggcccgtcatgtaagtgatgtcagtcccttctactgccttggccctgcacttacagtgcattgtgacacataacaaggtactgcacacagacgatgtgattctcctttttgggttctgccaaaaggaagcattgtaataaatcgcttggctcagtaaaaaagt

SEQ ID NO: 67463 - DNA, 1099 bp, Homo sapiens
ctctgctgtttgtcctggaccctgccaagagagggaatttttacatattgatgagctcagcagccaggaatcaaatccgagttcgtctacagctgattcggcaggtaccagggcgtccgcgatggtgagtgatagcaccgcgatggtggtattgctccatatgcctgagaccctaacaaaagcctaattacaactcatatgcctggagccaggacatgtgcaggatggtgatgtaactttcctctctggaatgggtcctgcacaaaggaatgatagtaacatattgcaaagccagacacacagccatgatggtccaagttatattgggattcagccaatagaagatattttgcctgtcatccctaagcttaggacaatagggtcctgcccacaagaaagattgtgacatctcactggacaagcacccacccagactctgccaagagaggggattattacatattgcagagcccagcacctaggtggagtgactctcatctttttcttctaccccgtatatagccagcttggtgacctactatttgaggctatacccaggcccagaccacagatgaaattgtgcaatatgtggaacaaacacctaaacaatatataacaccttccttggctctgtctacaaagggcacttttatatatcactgggaccatcaaccaggtgatgttgtgccatataactgagaccgtatcaaaagcctaataacaagacgtatgtctggagccccgatatgcacaggatggtgatataaccctcttctctggaatgggccccacacaaaggaaggatagtgacatattgcaagcccaggcacacaggcccagagcacagttgaaattgtgacatatgtacaccaagcaaccaagcaatgtataacacctcatttggcaatggaatcgagggcacttttacatatcactgagaccagcgcccagctgatgtgaaatattggcctgaaccctgcctacaaaagcattgtggcttttatctagctccattacataagtgatgtgacttccttctactgccttggccctgcacttatggtgaatcgtgacacaaaattgggtagagcaaccaggt

SEQ ID NO: 67464 - DNA, 1017 bp, Homo sapiens
ctctgctgtttgtcctggaccctgccaagagagggaatttttacatattgatgagctcagcagccaggaatcaaatccgagttcgtctacagctgattcggcaggtaccagggcgtccgcgatggtgagtgatagcaccgcgatggtggtattgctccatatgcctgagaccctaacaaaagcctaattacaactcatatgcctggagccaggacatgtgcaggatggtgatgtaactttcctctctggaatgggtcctgcacaaaggaatgatagtaacatattgcaaagccagacacacagccatgatggtccaagttatattgggattcagccaatagaagatattttgcctgtcatccctaagcttaggacaatagggtcctgcccacaagaaagattgtgacatctcactggacaagcacccacccagactctgccaagagaggggattattacatattgcagagcccagcacctaggtggagtgactctcatctttttcttctaccccgtatatagccagcttggtgacctactatttgaggctatacccaggcccagaccacagatgaaattgtgcaatatgtggaacaaacacctaaacaatatataacaccttccttggctctgtctacaaagggcacttttatatatcactgggaccatcaaccaggtgatataaccctcttctctggaatgggccccacacaaaggaaggatagtgacatattgcaagcccaggcacacaggcccagagcacagttgaaattgtgacatatgtacaccaagcaaccaagcaatgtataacacctcatttggcaatggaatcgagggcacttttacatatcactgagaccagcgcccagctgatgtgaaatattggcctgaaccctgcctacaaaagcattgtggcttttatctagctccattacataagtgatgtgacttccttctactgccttggccctgcacttatggtgaatcgtgacacaaaattgggtagagcaaccaggt

SEQ ID NO: 67465 - DNA, 444 bp, Homo sapiens
ccaaaaatgggattatgacatatacctttcttcatttcacagccatgatggtccaagttatattgggattcagccaatagaagatattttgcctgtcatccctaagcttaggacaataggtaaaatcctgggttgcatatttgtacaaagctcacagaagtttacaacacttactcataatgtataaacttgggtggtacagacagtttcataacaaggcccggcaaaaagttaagattgtgactctcaattacacacccaggtgaaagtaaaatctgtcaccatcccacatttacaaagcccactgttgcagtactgagtctaataggtgaaaacagtacaaagatggaattttgactctcatatgtgcatcgggccacaggtgcgattgtgactcatttttggatccatctcacaggcataaaatgtgtctcattcctgaac

SEQ ID NO: 67466 - DNA, 559 bp, Homo sapiens
aggtgtgaagaccgtgcttcagagctgggcactgggagagggcagacacaaaccggagtgcagagtacagggctattctcagctccctgcgtgaaaccagggagctctgcctctgctgatggagctgcgccaagtccttatttgatggccgcgtcctgctggagacactgagtttgcagtggcaccaaatcctctgtgtgtgccctttgttgtggccgctccacatttccaggatggtctccacccagaatttgatttgaacgttgagaccacataatagggttttctggagagagcagggccggcttctcaagctggtctgaaaatgaaagacagggaagagaaaggagaaaggagactggtctggggattgtatggtgattagcggttaggtttgggcgagggttccgtgtgggcaggggcttacatggtttgaaccttctgctgcagccaagcgggagagcatccagactttcttatcagcttgcccagatgtggggcagaaggggaagagcgagggatggggcttaaaaaaaaaagctgtcagcagttaaagagc

SEQ ID NO: 67467 - DNA, 1307 bp, Homo sapiens
tttgttcacgtgctgtaatatattttatttaacttgattaatcatggacttattgtgaccaaataaagttgaaaaaagatatatatcaaatacacctgatatgtatatatatagcatatttctatatatagacatactctgtaaagaacacgttcttttctgctgtccatgaagtgtatttgatatatatcttttttcaactttatttgttcacgtgctgtaatatattttatttaacttgattaatcatggacttattgtgaccactcacactaccaattgatttctgttgttttctctcatttcaagaagttttcactttacatgagtactgagtgattgtgtagcaattttatgatagtgaaaggttggaaacaacctgcaggtccatcattaaggaaatggggtaaacaaattagggaagagccacacaaagggacactatgcagtcattaaaatgatgctgtagagcagtctcgttctccagcgttcagtctcaggatcactttccactcttgattattgaggatcccaaagaacttttgtttatatgggttatatctgtcaatagttagcatattcaaaataaaaatgaaggaattttaaactatgtatttattaacttgcataatgataagtctatttcatgttctcctgaaaaacatatttttattaaaaataactttttttaagacaaaaaagttaatgagaagaatggcatcattttacacttttgcaaatctctttaatatatgtctggcttattagaagacagctggctggctttgcatatcacacattatgcagcctttggaaaaccccactatacactcaagagagagaatgagagtgaagtggcagacaatgtcttattattgggaaaatacttttgacccaatggactgcattaaatggtctcggggatctccagaggtccccagaccatacactgaggaccagcgatgcaaagtaatatttaacaagagaaaactatttatatgatacactgttacgtgaagaaatgcaatatgcgattaatcacattaaaaatatctaccccctgtaatcccagcactttgggaggccgaggcgggctgatcacccgaggtcaggagttcaagaccagcctgaccaacatggagaaaccccgtctctactaaaaatacaaaattagcggggcatgatggcaggtgcctgtaatcccagctactcaggaagctgaggcaggagaattggaggcggaggttgcggtgagctgagatcgcgccactgctctccagcctgggcaacaagagcgaaactctgtc

SEQ ID NO: 67468 - DNA, 152 bp, Homo sapiens
ggggataagaaggttagcaatcagggaaatataaccatgaaagaaaggcacagagaaatgtatcattgctggccttgcaggtggaggaagggtcaggagccaaggagtgtagatggtcctagacactggacgggggcaaggaaatagattct

SEQ ID NO: 67469 - DNA, 354 bp, Homo sapiens
cactcacaaacactcttacggcaggtgagggcagggtgggaaggaggttgtggttaaggtaagaggagcccggattcctctctctctttccttacccagacgggcctttccttctgtggccttagcctgggttcctatctgtagcatgcagaggactggcccaccctgggctgagaccctctctccaaccgggtcaggaagctgggcctggttcctttgccccaccctgctctcctcacacaaaacattcctctccctggagctggtgtgggccctgcatgctgactcagtcattttagacctcccagctctctggcccagctgctgaaggaatggaactggtgggagaggggt

SEQ ID NO: 67470 - DNA, 630 bp, Homo sapiens
gtggaataggccctggtgaccttgagcagattcctttcacttgtctggaccactctggctcctacaggggttctgtctgtgaaatcaggggccctaggtgacttcttgggacacttactgttctggctagccatttcatggatgacgagactgaggtccaggaaagagggacttgtccaaggtcatttgcctgtggtggtttgaggtagtaatataatcaaaatgacaataagaaaagggttaactaagttcagttaggctctttgaggatttctcagaaggtaggtgttgatgagaatctccaggaccttccagcactctccctgccccagcagtcctgaaagccctgtctgtgcctacctgtctctcctagaatctgcactaagggggcagggctggggctcttcatctgtcctctgatggtcgctcggatctgatggtttcctaggaactaactgtgggcccagacttgtgaccatttgtgatggaggagagagaagataagaaggctgtgtttatagtctcttgcctactggcccttgaggaagtggcctggggcttccagcaacacttgtgagcttccagttcctgctgcaacttatgggtcaactcaagctttaaggcgttctg

SEQ ID NO: 67471 - DNA, 4479 bp, Homo sapiens
ggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatacgtgagtccagtgtccagcctgggacacctgtaggaggcgccttcctggcagacgaatgagggagcaagttccctgtgatgggaccatctccttacccacctgggctagcgggccccaggagagagacccaggagtgtcctcgtccgaggagagccagcccctgctgatccttatgggtccccatttgcctagtgccatagggccacggccttgggaaacagagggcacgggctccacactagcagctcccaggccagggcctacgacacacgggagaatggaggaaatgtgacataaaatatagatttctacttctgctaaaccttgggcccacggtattggctgcagctatgttgctgctgccccttcactggtacagaggctctctgtttgccattgttcccaacactctgtattttattatatctgtcagcccttatctctcatttatactatgtttggcctctgtgtatattagagtttagacccctgatggaaggtctgccctcaaacttgcaaacttaaccccagtgaagagcagccagagaagagttcctgaaaccctatctgcctcccacctgcaccatctcgcccactcacccctaaccacaaacacacagtcacacactgtcacccacagtcacacccacacctagtcacacactcgcaggcacacttgatcacacctacacctacacatggtcccacagtcacacatgagtcacacccgatcacacccacacacggcgacaggcccttggcaccattcaccaccaagagtcagctctggatccagaggtgaagcagagctggtgcctgcttcaagcagctctcaacccagggcagaggcagacatagccaggcagttatgatgcagttcattcattcattcagcacaggattgttaagggcctaccatatgccggacccagagccaggccctgaggattcggcggggaagaaagctgggacctgtcctctcagggctggcagtcgggaagagacagatggtgaacaagcagaacaaacaaatgtgtgcatgtacatacgtgtgtatgcaaaattgtacattgtggtaagagtcaaaatgaagggtggagaatgggaaggcctctgcgtggagagcttgaagcctcccaaaggaggagaaggaagagaagggagagtgttctgtagcaggagcagctggcgctgagcaggtgccaggaggcaggtggaggctgagccctgccctgggaccagcacatgcagggcatgtggcaggcctgactcctccagctctctggctcggccacggggcctgcctgtgtctgctgccgagcttgagctcccccagccctgtgggctgctctccagcccctgcgctgctgctcagtgagggctgtgtgcacccgtgtgccccacaagaccatggttcatggcagatcccaaactcgccattgctcctgcctaggggacagcttagggtgttctgggtgggggtgatggggtgtgggatgatgccagccggcatggaggaaatggggtggcacggctatgggggtggcaggattcccctcctgtccctgcactgaagagaggagggctttgtagaacctctggggcaagtgtgggaggcctgctgcagacatggggcccagcggtctctgctgccacagggcttggcccagcgcctgcctctcaggtagtctggaggaagccacagtcattgaaccagtatccttgtcccactccctccctttttctagcctctcttgggtcggggaagggggagctcagtgtcccctcccttgcacccctctgcctccaccagcctggaggttgggcccaggcctgtgggggtggggaggtggccacccacttggctgtcccagccctgtcccagacagccctgtattcctgcagcctgggcttgttcccaaacagggtgaggctcctggggtgggcctggctcacctggggctctcccctgcccccacagtggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactgggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttatttcctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcgccgtggctgcagagctgcctgatgggcactagagggcacgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtatggagtgatcctgccgccccctccctgggctggtccagagatctcaaactccgatgcccctggggccacgtatgttgtgtaaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattgtg

SEQ ID NO: 67472 - DNA, 2465 bp, Homo sapiens
ggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttatttcctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcgccgtggctgcagagctgcctgatgggcactagagggcacgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtatggagtgatcctgccgccccctccctgggctggtccagagatctcaaactccgatgcccctggggccacgtatgttgtgtaaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattgtg

SEQ ID NO: 67473 - DNA, 488 bp, Homo sapiens
  misc_feature (55)..(55): n is a, c, g, or t
  misc_feature (57)..(57): n is a, c, g, or t
aaaattttttttttttggggggggggccccccccccccctttcccggaaaagggngnccaagaattcggcacgaggtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattgtg

SEQ ID NO: 67474 - DNA, 2689 bp, Homo sapiens
ggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctggttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatacgaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccaggtacccttgtggccccacgtgcccctccccttgccggggccgccctcactctcccctcacctgtcctctgtcttacagatctttggcatctgcctggcccagaacctcgtgagtgacatcaaggcagtgaaagccaactggtgaggccgccagaggccatggccacatgcctggcctacgcaggcctctggggggccccccaggaccctcctactatactcctgacgggcaaggctgcaggagatgttcctgctgggactgagccttgaggggttcgcctgaaccgctgtgctgtccacccacggaggaagttgctgtgcctccgcctgggcctcttgtcccgtatgcgtgtgtacacacacatgcaggcacacgtgtgcacagggagccaccgtctcggctacatttggggtggtggactctccagggactaggaagggcgcagctcagagggtgcaggccaagtggggtgggaggtgctgtgtggagggtcccccccgttccctgccccccagtgctgggacgcacctttctgtgcgtagctgtatggggcgcgttgcctgagccactgcctcacacagcttcagagcactcttttctatgagctgtaactttgagcctgccaggaacccacctcagcctcagtgtcccagactctgaaatgggtccaagaattttctttctcttgcttgcctctcaggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttatttcctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcgccgtggctgcagagctgcctgatgggcactagagggcacgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtatggagtgatcctgccgccccctccctgggctggtccagagatctcaaactccgatgcccctggggccacgtatgttgtgtaaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccacaatgtggctccttggccccgctggccagtgtcctgggcccctgacaggcgctggctgtgagtggtttgtacatgctacaataaatgcagctggcagcattgtg

SEQ ID NO: 67475 - DNA, 1000 bp, Homo sapiens
tcaggtcactaggcatcaacagtaggcgtacaacgcatgggcactggcccggtcgtttagaaaagggggatctggatggttgactcctaggagtcaagttcagcatcttcgccgtggctgcagagctgcctgatgggcactagagggcacgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtatggagtgatcctgccgccccctccctgggctggtccagagatctcaaactccgatgcccctggggccacgtatgttgtgtaaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattgtg

SEQ ID NO: 67476 - DNA, 2719 bp, Homo sapiens
ggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctggttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatacgaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccaggtacccttgtggccccacgtgcccctccccttgccggggccgccctcactctcccctcacctgtcctctgtcttacagatctttggcatctgcctggcccagaacctcgtgagtgacatcaaggcagtgaaagccaactggtgaggccgccagaggccatggccacatgcctggcctacgcaggcctctggggggccccccaggaccctcctactatactcctgacgggcaaggctgcaggagatgttcctgctgggactgagccttgaggggttcgcctgaaccgctgtgctgtccacccacggaggaagttgctgtgcctccgcctgggcctcttgtcccgtatgcgtgtgtacacacacatgcaggcacacgtgtgcacagggagccaccgtctcggctacatttggggtggtggactctccagggactaggaagggcgcagctcagagggtgcaggccaagtggggtgggaggtgctgtgtggagggtcccccccgttccctgccccccagtgctgggacgcacctttctgtgcgtagctgtatggggcgcgttgcctgagccactgcctcacacagcttcagagcactcttttctatgagctgtaactttgagcctgccaggaacccacctcagcctcagtgtcccagactctgaaatgggtccaagaattttctttctcttgcttgcctctcaggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttatttcctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcgccgtggctgcagagctgcctgatgggcactagagggcacgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtatggagtgatcctgccgccccctccctgggctggtccagagatctcaaactccgatgcccctggggccacgtatgttgtgtaaatggatgaaacaggcccttgagttgggagcctgcttcactttgactttcccactgttgctggagacaaagacatcgtgatgagagaaagttcgcacaatctattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattgtg

SEQ ID NO: 67477 - DNA, 2123 bp, Homo sapiens
ggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctggttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatacgaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccaggtacccttgtggccccacgtgcccctccccttgccggggccgccctcactctcccctcacctgtcctctgtcttacagatctttggcatctgcctggcccagaacctcgtgagtgacatcaaggcagtgaaagccaactggtgaggccgccagaggccatggccacatgcctggcctacgcaggcctctggggggccccccaggaccctcctactatactcctgacgggcaaggctgcaggagatgttcctgctgggactgagccttgaggggttcgcctgaaccgctgtgctgtccacccacggaggaagttgctgtgcctccgcctgggcctcttgtcccgtatgcgtgtgtacacacacatgcaggcacacgtgtgcacagggagccaccgtctcggctacatttggggtggtggactctccagggactaggaagggcgcagctcagagggtgcaggccaagtggggtgggaggtgctgtgtggagggtcccccccgttccctgccccccagtgctgggacgcacctttctgtgcgtagctgtatggggcgcgttgcctgagccactgcctcacacagcttcagagcactcttttctatgagctgtaactttgagcctgccaggaacccacctcagcctcagtgtcccagactctgaaatgggtccaagaattttctttctcttgcttgcctctcaggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttatttcctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcgccgtggctgcagagctgcctgatgggcactagagggcacgccagccccacactccctgggtctggcttcctcccgcaacctcactctagtagagcgactcgttgactgcctcctccctgcaattttttacgggtgcctccggctgtcgacaggcccgctgtgagccgcagtcttgtgggtgcaagtgacaacagccgggcg

SEQ ID NO: 67478 - DNA, 2811 bp, Homo sapiens
ggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctggttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatacgaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccaggtacccttgtggccccacgtgcccctccccttgccggggccgccctcactctcccctcacctgtcctctgtcttacagatctttggcatctgcctggcccagaacctcgtgagtgacatcaaggcagtgaaagccaactggtgaggccgccagaggccatggccacatgcctggcctacgcaggcctctggggggccccccaggaccctcctactatactcctgacgggcaaggctgcaggagatgttcctgctgggactgagccttgaggggttcgcctgaaccgctgtgctgtccacccacggaggaagttgctgtgcctccgcctgggcctcttgtcccgtatgcgtgtgtacacacacatgcaggcacacgtgtgcacagggagccaccgtctcggctacatttggggtggtggactctccagggactaggaagggcgcagctcagagggtgcaggccaagtggggtgggaggtgctgtgtggagggtcccccccgttccctgccccccagtgctgggacgcacctttctgtgcgtagctgtatggggcgcgttgcctgagccactgcctcacacagcttcagagcactcttttctatgagctgtaactttgagcctgccaggaacccacctcagcctcagtgtcccagactctgaaatgggtccaagaattttctttctcttgcttgcctctcaggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttatttcctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcgccgtggctgcagagctgcctgatgggcactagagggcacgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtatggagtgatcctgccgccccctccctgggctggtccagagatctcaaactccgatgcccctggggccacgtatgttgtgtaaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattgtg

SEQ ID NO: 67479 - DNA, 2891 bp, Homo sapiens
  misc_feature (2818)..(2818): n is a, c, g, or t
ggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctggttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatacgaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccaggtacccttgtggccccacgtgcccctccccttgccggggccgccctcactctcccctcacctgtcctctgtcttacagatctttggcatctgcctggcccagaacctcgtgagtgacatcaaggcagtgaaagccaactggtgaggccgccagaggccatggccacatgcctggcctacgcaggcctctggggggccccccaggaccctcctactatactcctgacgggcaaggctgcaggagatgttcctgctgggactgagccttgaggggttcgcctgaaccgctgtgctgtccacccacggaggaagttgctgtgcctccgcctgggcctcttgtcccgtatgcgtgtgtacacacacatgcaggcacacgtgtgcacagggagccaccgtctcggctacatttggggtggtggactctccagggactaggaagggcgcagctcagagggtgcaggccaagtggggtgggaggtgctgtgtggagggtcccccccgttccctgccccccagtgctgggacgcacctttctgtgcgtagctgtatggggcgcgttgcctgagccactgcctcacacagcttcagagcactcttttctatgagctgtaactttgagcctgccaggaacccacctcagcctcagtgtcccagactctgaaatgggtccaagaattttctttctcttgcttgcctctcaggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttatttcctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcgccgtggctgcagagctgcctgatgggcactagagggcacgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtatggagtgatcctgccgccccctccctgggctggtccagagatctcaaactccgatgcccctggggccacgtatgttgtgtaaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattgtgaaaaaanaaacaaaaaaaccccgagtttattaatcattggccgggaaataaaacccttttttttgaaaagcggggccaca

SEQ ID NO: 67480 - DNA, 2527 bp, Homo sapiens
ggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctggttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatacgaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccaggtacccttgtggccccacgtgcccctccccttgccggggccgccctcactctcccctcacctgtcctctgtcttacagatctttggcatctgcctggcccagaacctcgtgagtgacatcaaggcagtgaaagccaactggtgaggccgccagaggccatggccacatgcctggcctacgcaggcctctggggggccccccaggaccctcctactatactcctgacgggcaaggctgcaggagatgttcctgctgggactgagccttgaggggttcgcctgaaccgctgtgctgtccacccacggaggaagttgctgtgcctccgcctgggcctcttgtcccgtatgcgtgtgtacacacacatgcaggcacacgtgtgcacagggagccaccgtctcggctacatttggggtggtggactctccagggactaggaagggcgcagctcagagggtgcaggccaagtggggtgggaggtgctgtgtggagggtcccccccgttccctgccccccagtgctgggacgcacctttctgtgcgtagctgtatggggcgcgttgcctgagccactgcctcacacagcttcagagcactcttttctatgagctgtaactttgagcctgccaggaacccacctcagcctcagtgtcccagactctgaaatgggtccaagaattttctttctcttgcttgcctctcaggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttatttcctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcgccgtggctgcagagctgcctgatgggcactagagggcacgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtatggagtgatcctgccgccccctccctgggctggtccagagatctcaaactccgatgcccctggggccacgtatgttgtgtaaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtgagattcctgataactaggcgggacc

SEQ ID NO: 67481 - DNA, 311 bp, Homo sapiens
actctcaggttagttctaggctttcaacattgtaaatagtgctttggcgtaactgtgcttgtttgttgccctcctaaattaatagtgctttcctcttcaccaaagaagtggtagttcttactttttgtgtgagtccacataaagaagttttaattcagatctcacttttaaatactttggtttacagagaggagttgaattaacttttattcctaagtgactctaagaccattagattttaaaaagcatttgggatacagcaactgtcttctgctgttaaatttttttattttttattttattttattttt

SEQ ID NO: 67482 - DNA, 600 bp, Homo sapiens
gagtgaaaggtagtaaaatgaaagtaatgagaagcaggcttcatttatgctcaggaaaaaagtgacagtatctgtataaatatttacattcttgaaattatggtcaaagatatgaattctacttaaaaattgtggctaacaacatgaaatcaaagcaaaggcacagtggtaggaaagttcaacatgagtttgtggaataacaggtaatctgttttggaaggagtttatgaaagcaatagtggcgtaataggtagtaatgagacagtcctcatttaccgtaaacatttaaaaaggcaatacttctttaaacatccacattttaaaaaatatggtcaaaaacattaaaccaaatacttctgtgtacagagacagtcatttaaagatacttatttaatcccaaaagctttctaggaggacactcagtttccactattgacaaagaggtggtcctgtggactcccagcagataagaattataaagattacattttaaaaactatgtcaaatactggaaaatgtccaaaatatagatggaaacgggaagagagtttaatttcaaaaaattgcaaatggaagaagtataaattgtgaatttttggc

SEQ ID NO: 67483 - DNA, 287 bp, Homo sapiens
tagtggatactcagtacatcttatttgagaaaactcaccaatggctgatgctcagtttgggtgcgacaaggccgacccctagtgaggagctgcaagggtgtcagggagtggggcggtgacaggggaggaggcttcctgggggtcttcctgataccaggctctgggagaggctctcgggcagctccaaggtggggtcttggtttgggtgttccccacgagcagcccttgacacaaggatttgagttcaatttgttaatttttgggaaattaacaaatttaatttccca

SEQ ID NO: 67484 - DNA, 2143 bp, Homo sapiens
atttgagtctaggaaacctggctcagggacccacactcttaaaaatcatgccgtaatgtcattatgctgtattgcctaagacaaatgcatatatacactggtacaaataccttgtccgaaaaatgcccatagccttactgaagagactatttacaaatacggtatagatgaacaatgatgtgtgacagtagttgtcactggctcttccctaggtagccagggaaaggctcatttatttgagaaaagcaaaggcatagaagggatatttttgtgtaggaatgggaggttggggatgtgtaagagatgagattgggaaaaacctcattgtgtgtatatctatttatttataaaaatattcatgtactaccacagtatattatgtgctttataaaaaacattcaaaaaagacaaaaatgaaaaattatacataaacaggatttctaattatctttccccacccctattgtattttcttgaacacctaggaatatccttactctgggctatagaaataatggaaggttgttacataaatatatttaatataggtaaatattacattctgctttatttataggtatgttcacagattaattatagggccatctatgtgctttttttttttttttaagacaattttattcttcattcatgtctcacatggcgtatctgacctggtgctccatacataatgggcatgcattagggtgactggcttgctccttttactttgtgcccaactgtctcaggtacatgttagtgtttaacaaacaaccccaaaacttggatggaggctaaataacaatggctcagaattctgtgggttactccacagcttcagctttcttacagctattctgggcctggatggtctaagacgggctctcacgtatttggctgttggttagttggactaggagagcctcagccgggtcatctcatctcagctgtatgtgactctcaacttacaagaagctagaccaggcttccccacatggtggtctcaggataacattccaagaacgtgagagttgaagctcccaacatctcatttgtgaaagaatgtcacaatgtcagcccagattcaagattgaggaaatagattacacctctacatggaagaagatacaaggccacattgcaaaggaatggaaggaattaactgcagccatctttgaaaaagttcaccacacccacagattcagatttctgtgaaaatctaataaaagtctagtttaaaagaggagcgaaatatatttggttctttacttcttttcatttcctggaagtacatagggtttggtttttgttttttttttttacatgatgaattcctatgttttcctcttgcccacatagtcctgtgtggaacaatagtctactgataagaatcaacttgtatcctgctgctaatcaatgagaatttctctgccctcatcaacttaatctaggatatcccttccagaataccaagataatgtaagcttttatttagcagggtaatttgctaaacattgttcataagtagtgcccttttagcttaaggcagccctgagctgcaacagaagactgaatggagctctgtatacattctagcttcctcacctcactcttaaagtgggttagatgaaatctggtaggagaacatagatcatttgccagtgatgatattcataagtggtaaaaaaaggaatgacctgaaacatttttatactgtgtttgttattcttctaaagagattagagttttactgagaccaccaattctctttggaggctggggatagtagcatcaacattctcactgattaatgaagtggtgttcacattggatttgtgaacagacccatcatatgcagacttctggtctactgaggagcatgtgtctctacatgtttacagtggtggagtttccttgcccctctgccaataaccacaaaatgatcagtaatgagaaataattaagtatctagaggaagaaaacaaagacatgaatttcatgatactctcatgctttgtattatcagtgacttcattgtttctcttggcaaatttttaatgcatctgtgcttggcccaggggtgcatactagggtaaagaaaaattttgtaatagcaacagtggtttgggattttcagggtacc

SEQ ID NO: 67485 - DNA, 898 bp, Homo sapiens
attaccaacatgcgcctggccaggtctcagtcttttagcaaccctggatctctggactgtaaacttcacttggactttgtagttcctccattcctcccttaagtgggacaggatgagtcaagtgggctgatgttggctatttctcttcctccaggtgaaaggcaggagctggagttgggtatctcccttctggtcagttaggctctgataaaacccctgcaggtttagctcacgttaaatagttcaccgcgctcagccctagtttaatggtttttagtatattcccagagttatgctattttaggacatttttataaccttacaaagagtccctgcccattagcagtagctcctcattccctacttttccagctactgacaatcactaatgtactttctaaggatttgcctattgtgggcatttcatttttatttttaattgattgattgattgatggatggatggagtctcgctgtgtggcccaggcttggagtgcagtgtcatgagctcagctcactgcagcctctgtctccttgttcaagcgattctcctgcctcatcctcccgagtagctgggattacaggtgggcaccaccacgcctggctaatttttgtatttttagtagagacagggtttcactatgttggccaggctggtctcaaactcctgacctcacgtaattcactcgcctcggccttccagattgctgggattacaggcgtgagtcactatgcccggccaattctaggcatttcatgtaatgtaatcatatgttctatggccatatgtgtctggcttcttagcataatgttttcaaggttcatcatctatgtatcagtacttcatttctttttgttttaacagactttattttatagagcagttttaggtttacag

SEQ ID NO: 67486 - DNA, 474 bp, Homo sapiens
tgttgaccttcacctacacagatgactcacatatgtttccataagctggcagtaagtttaagaagcataccatgccctgaggaaaaagaagtaatgttagctcttctactcttggccaaagaacctaattctgtatattacttctgtctttggtttggctattatagacaataaattattgatctgattataattgagaaaagtaagctcttctaaagaagtaaaatatggatctagggaaaggaagttagctcccagagcatttacaatttcccaggaattctgtgactttaccaaccctaggcagtgctgatactttaaaagcattcatttcacttgcttttttttggctcaccccctatcccccaggtatacagtactcttacataattgtggaagaatcttacaagggggtaatgtagatcagactttcctgctttcatttttaacctccctaaattataaatatttatt

SEQ ID NO: 67487 - DNA, 320 bp, Homo sapiens
ggatcatgcctttggtgttatagttaaaatgtcattgccatacccaagatcatctaagttttctcctacattattttctaggagttttatacttttgcattgtacatttagctatttggtctgctttgagttaatttttgtgaagagtgtaaagcctgtgtataaattcatctttttgcatgtgatgtctagttgttccagcatgatttgttgaaaagatatgtttgctccattgtattgcctttgcatcattgtcaaagatcagctcattatatttatgtggttctatttccaagctctctattttgtcctattgatct

SEQ ID NO: 67488 - DNA, 360 bp, Homo sapiens
taatataataaaatactacatagcaataaaaatttaaaaattattattacctgcaaaagcatagataaattgcacaaatataatattgaccaaataagccagatacaaaagaagatgtaattccattttgataaattttagaagaggcaaactaatgcatgatgttaaaatcagagtagtggttacttttgaggaatgaaaagggatggtagttggaaaacagcttttagggagtttctggggtgttggcaatgttctatttcttgatttggattgtggttttgtaggcatattcactgtaggataatcagttgactttatgatctgtacatgtttctatatgtatgttgctcttaaatt

SEQ ID NO: 67489 - DNA, 549 bp, Homo sapiens
tccttcctaacagcaaatatcttccactgagatcgtgtggttttaatcatacaaggagagtggcagaagaacagaaagattgaaaccaaggacagagaacacctgaaattgcttcagggtcatatgtcacagcgctgggcatttcatttgggtatctatcatcattcccattctgcaatgaggaaatgctgtcagagtgattaagtaatttgcccatggtctcacatagaagcctgtcttctccagggaacacagcactcagaatcgtctcggcccctgcataagcctgcatgagcctgggctctggggacccatcctggtgcatcattcgttggctctgtgacaatgggcacatcgtttaacctctcttggcttcattctccttactggaatgatggagagagttttgcctatttcagaggcttgctcttctatacgtgagcctataagtaacttgtcttaagaatttccactccttctgtactctgatttaaatttgaaggcatcaaaacaaaaacaatcaagatttcagattccaaatactttcat

SEQ ID NO: 67490 - DNA, 1089 bp, Homo sapiens
aaggtcaccagtcatattggatccctattctaatgatctcctttgaatttgattacatttaaaagatcttatttctaaagaagatcacatgcacaggtactgaagcttcagatttcaacatatattttgggaggacaacattcagcctgtaacactgattattctattataccttcttctgaacttctgaaagttgaagcatcctagctgagtcttcagacttcttcttttgcatactccctcagtaataatcttatcgggtcctaagtctttaaacatcacctcaacattaaagtttccaaacattatattattgatgccaatttgtttcctgaattccaaattcatatgttcaactgcaaaatctatatttctaactaaagaaatccaaaacaaagccttttttctgattcctgccgaccctcccatcaaacatgtccttctattctttctcatcttaggaaatgaaaatactatttctcactgttgctcacattaaaaatttgaataactttaaactttgttaaaacccagtaaatctgaaatttagcatcctaaatttaccatctagcatcgtctgatatccttgcccagtcatcattgttttttgtttctaatttaactttagcccttgcaatagttctctaattggtcttcctgtttacattattacacattgtattccatcatctgcaaactaaccacagtagtcattttcatgttcaaaacttttattggcttctcattacacatagaacaaagttcatatttttaaactctaaacaatattgttctatgtaatctagcattgcatcctcctcctcaatctcacttccttcccttcttcctgttgctcactccactagctttctagcttctgtttgaataagtcaagcactttcctacctcaagggctttgcaatagttcctttctgccgggcacagttttctcaaccttctcatgaatttctttccacaaatattctttttttttttttttttttgatggagtcttgctctgtcaccacccaggctggagtgtagtggtgtgatctcagctcactgcaacctccacctcctggattcaag

SEQ ID NO: 67491 - DNA, 408 bp, Homo sapiens
tagctttgttcactttttgcaacaaaatgtatgggccgatttattttcccattatattgtaacttcttgaaaagctcttttacagtggctttgtttcaataagcccttaagttaagggctgattgcacttagaaataagttgcacttagaaataattatttggctattaattggattttgacaagaaccaatgtaaaatttcatttttatattttcttaacaagaagaaaaatattctatgaaagcaaagtaatgctaacttaatgaatctgcttattgtatggattaatcactaatattattcccatgtattttgttttactaaagatttttaagaatccagtggctatttgaacctactgttatctaactttgagcaacaataaatgaaacattaatcagtaaaga

SEQ ID NO: 67492 - DNA, 250 bp, Homo sapiens
aaagctatgtaaatataataatagcattttttgagtattctgttctaaaagctttacataaactaactcatttattacttatagccttagaagtaatatgaattatcatcatcaccatcttagaaaagaggaaacagaccacagagaggtgataagtgcctttctcaagccttcttatttaggagagggcatatttgaaaccaaccagtctggagccaggtagagccccagctcacacccttaaatatta

SEQ ID NO: 67493 - DNA, 510 bp, Homo sapiens
gatcttgtctcaaaaaaataaaagaagaaatcagccgggccgcagtggcttatgcctgtaatcctagcactttgggaggctgaggcgggtggatcacttgaggtcaggagttcaaaaccagcctggccaacatgacgaaaccctgtctctactaaaaatacaaaaattagccaggcatggtggtgcgctcctgtagtcccagctacttgggagattgaaacagaagaatagcctgaacccaggaggtggaagttgtagtgagccgagatcatgccactgcactccaggttgggtgacagagagaggctccatctcataaaaaaagaaaagaaaaagcatttctgaaaggaataaaaaacaaattgataacatcccctaatctctagttgttgggatgtagtatccttcatttgatcaggaaatcatatgattgttcttaaattattaagttggcagaatttgtgtggtttcataatgatgcttgtaagatgatattttaatggaaatgtt

SEQ ID NO: 67494 - DNA, 2697 bp, Homo sapiens
  misc_feature (1328)..(1328): n is a, c, g, or t
  misc_feature (1392)..(1393): n is a, c, g, or t
  misc_feature (1773)..(1773): n is a, c, g, or t
  misc_feature (2139)..(2139): n is a, c, g, or t
  misc_feature (2371)..(2371): n is a, c, g, or t
  misc_feature (2385)..(2385): n is a, c, g, or t
gcatgtggaacacacgtgacatttattacgttttctgtcttacgtgggtgcagttgttggttccccaaaacaattacagagtaaaatcgaagatcactaagtacagatcaccatgacagatataatgataatgaaaaaattcgaaatattacaagaattaccaaaatgtgaaacagagatatgaagtgagcacaagctgtttgaaaacgggacccacagatgtgccccaacggagttaccacaaacttccaatttgtaaaaacaagtgcagtatctgcgaggcacaatagagcaaggcgcaacaaaacgaggtccgcctgtgcgtgcgaacccctcgcagggaggctgtaaacacaacgcaggaacatcatgaaaaagcccgttccggcgctgggctgcagagggcgctgtcgggtaaacaggtcatttcgcggcacaaagcagctcacagcgcatctctgaagtaacgcggtcagattcacctttccaacatgtgccatgcaacaaactgggtcactgaaaaccgcggaagtttattcctcaccccccccccgcccccggaccaggtgggttgcgccctcagggagctgagccgtccccgtgaggccccttcgctgccagcacagttcagctgtgccgtccccaccgctgcggtgcctgtagctggtgtgcggaggaatcgtggtcagaaatgtgcacacgtggtccagacagacggccccgtgagtctccgaacagaaaagaggggggcgaggcggagtcctgaaggctaggcttgcagaggcgggagaaccaggcagggggccacgggcctgcggggctccggacagcgacaagggcggcgccccccacccgcctgcgctcccggaaggccgagtctgtcagcgctgcctgcggtgtgtggcagctgcgcgctccttccctgtggggcagagctggctggagccaccgcctgaagaaactgggctctgtcctccgctccggggaggggatcgtggccagtggatgctgagttccttctgttgcctgccgcagcccacagcgaagtcactctgaagagcatctcgctggcctgcgcttctgcttctaggcggctctgaccttgacacccctttcctcttctgcttatgccttcgaatcctacattaagggaaatggggatcctgttttgaaaccaaatgagaaagaaccacaaccctcaacttcaaaacacttccagtctcctgaaggttttttagattcggagatctccacccatttcccagggtccttgaaatgtttcctggagccgcgcctctcccagtgctctggctggagacagcagcggnggctgtcttcctccgcgtccttgtgagcacccagtttggggtggaagagtcaaaaaaaaaaaannccaggaacgccccaccctgtcgttctcagggtcccccggctcccccgggcttcctctctccgcctctcgtcttcctgcgtttgtctgatgggcactgcccgaggtttccggttgcacctgcgggacggaggaaaacgcacgcctgttccatcttcttaggaggggaattctgaggctttttgaatgaccaccgtgtagcgccttaattctccttcactttcaccggttttgtctgccccacctcaggaagactgtctgtgttctttcctccatagcccgggcaccgaaggcacatgccgtgcatacaaatttcctgtctcgtctcagactccacgtgagctcgttattacttcaatttaatctgcgcacgtttcaccctnggagagatactgccagatgtggcagcttctcctgacagatggcccgaggccattcttgccctaaaacttcaaatgctcacataaaaccatccttcctaacaacacaggttttcccatttctgtgaggttgacctttacacctgaagagtcatcgaaacccagctagtgataaagaagtgaagatttcaaaaaaacggagggagaatggaatctggtctctggttttcaagcgattccagttgcttgatttagtctcattggaatgtttgagcatttgaggaaaaggcccttaactctatttgccaaaccccataaagtaggagctgaactgacatttaaaatcggagcagccttgacgggcttgcnttcttacttgcgtcctttaaatctttcctggaacagagttgagaacgtataaatgtataaatgcgtgaaaacaggcaatgaacaaagtgttcattccagtctcgtgtctaaattccccggaacatgttttttctcctgccttttctctgaactccatgcaggtcaagtcacagccttttttttttttttcttttttcacagactctcactctgtctcccaggctggagtgcngtggcgcgatctcngctcactgcaacctccgcctcccaggttcaagcaattctcctgcatcagcctctggagtagctgggaccacaggtgcacacccccacgcctggatgaggtcataggctttgtcagctgtacccgcagtctccctgtgcacccagccacggttagaggtcactgtcttgaccctggcggtgacccttgctctttgcagttgtgccacccactctgcatccctacttgcagcagcttaatctggcctctttcaaaataatttcaaccgacggtaattgtatatatttcttaggtacaatgtgaagttttgatgt

SEQ ID NO: 67495 - DNA, 3015 bp, Homo sapiens
gagcaggcggcaccatggactgagcacctcccaggttccaagccctgggccagactggaacatggggggccagaacccaagaggatcctgaggagacagacggcagcaaacaaaatcatgcacaatggtgaaaggtgctctccctgacccatggggacccatggtaggaccctcgggagggtggcaggttggagggcccgtaagcctccccaggcaacactgatagtaccaaaagctggggagattcagggacctggaaactgtcatccaggtctgctgggaacgtgacatggcatagccactttggcagccagttgggcagtggctcacaaagttcaatggacttgaaccacgcgtccccaaagtgtcacagatattgaacccactgatttgaaaactgacgtccacatgaaacctgcaggccaggttcactgcttgattcctcgtcactcacacacggagccttcggggatggccttcaacacgggaatggggagaacaaggctggtcctcccttcaaacggaagacccagtgagaaaagggaacgagccagtgatgcccgcatgaacgtgggtggatcctaggtgcattttgctaagggaaagaagccagacccaataagctaccaaagtaggattcccattcttaggccattgtggaaaaggccaaaccatagggactgagaagcagtctgggtggccaggggctgacggatcggggagaggctgggtgcataggggccaccctggagacttggaggatgaaggagtcgctccaggaggggctggagtggtagccgggagactctgcacattggtttagaaccatggaggacctgtacacccaaagactgaattggcgtgtgtgcaaactgaaaaaaaaaaagatcattcagagtgaaaaggatcaggcaagtcactgtacaactgggctatttgcatgtcacagatgtggattttactgaaacatttcttcaacagtcaaagtccctgaagagctcactgcttatctggtgaatcatctgaacctgaaatgggatttgttgttagggtttgtagacaaagtgaaactaacagcatctgcacaacacaaaccaaagccccctttctctgtttcccaggcagcaggaactattctacatcctcctggcatattcgaagtataacccagtgagtattcctggcagtgaggttcccaggccgtatttccatattcacaggagtgggtgtctggtgggagtgtcgttgcttcttttaaagttagtatttgtgacccaccaggatataggaggtaggattccagctcaccgctggcataaacctccagcaagggggtggtctcaaggggtcaagctgagacacagaggagtcagggcctggactcctggtgtcacctgggcctgaccaccacttatcggaacaagcccctcctcctggggctgccccaaagcccgggagcttggcagcatcacacacagaatggtgctatcaggagacattttggacaaggtgctgaagtgcccgatggatatggctcttgtcatgaaatgaatttgcatcctgaggaagtctcttcttcagaggaagccttcccagtcacctctgccctctccgatgacatgagtcctcccaggtgacctcagccctcccaagtgacttacttccacggtgactctggctgttgcaggtggtgggctactgcagggacctgagccacatcgctgccttgttcctcctttatctgcctgaggaggacacattctgggcactggtgcagctgctggccagtgagaggcactcctgcaggcttgttgggagcctttaggacgtctctgctgacggtcccaaaggaacccggaactgaccccccagagcccaagtcagacgcctttcatccccatcagcagaaggcatctcatcctccccgtggctgccctctgtgtcctggagccacgccctccggctctgattctgtgcagctggctctccgcaacctgagagtcctcctgcccttcagttgctcaggctccagctgcccttggtacccacgaaagggtaccaagcccagatggcagcatctccccatcccgtgtcccttggcccagccccacttccaggagacgaccacaaagcccagcacccaccctgttctggccgccccctgtcgtggcctcaaagtcaggcttgccctcccggcaccctggcccaggaggcctccaggggcacctccagccaggctccaggggatgttcccacccctcctccccagggccaaggccacatggtggggtcaccagatgggagggtgggaggcctcggggtctggggggctctgcagctgcccagctcttccagctgatggctccacatcttgggggaaggctctgatttcatgacgggctgggggcttctcaggattccacagcccaaatggcgggacagttcaggggctccaagaccatcaggagcatgtggtacccacatcacaacccaagaccatggggcatctggacaaggaaggtctatgcacacagggttcctcattcagctggcttctccgggtgctgaatgatgggatctctctcgggctcaccccgtgcctgtgggatatgtatttgctggaaggggaacagatgttgatgctgataacaagcattgcctttaaggttcaaaggagcctctatgaagaaactaacaaggaaacatggggacctgccacccccagggccctcaagggcactggaagagccagacccatttgtgagagcctccactcctccctgcaagcgctgacagcctcagagagcagcagaggcccctcactcctgcagactcctccaagggtgccaggacaacaagccttgagccggggagacaagggaatcagtgtctcattatctctaccatctctaccatctcggagagggagatgtggcaggataatagggtaatagtggggtgagggtcagcaggaaaacatgaacaaatgtctctgtgtcataaacaaggttaagg

SEQ ID NO: 67496 - DNA, 937 bp, Homo sapiens
  misc_feature (4)..(4): n is a, c, g, or t
  misc_feature (6)..(6): n is a, c, g, or t
  misc_feature (11)..(11): n is a, c, g, or t
  misc_feature (16)..(17): n is a, c, g, or t
  misc_feature (24)..(24): n is a, c, g, or t
  misc_feature (28)..(28): n is a, c, g, or t
  misc_feature (31)..(31): n is a, c, g, or t
cagntntagancgcgnncggcccncttnttnttaagcagctttattacatttccagcaggcaggccagagagtgaggatgctgctggtgtgctggggaggaagtgcaggaatctgtagaggacagttgttttcagaagtccaagatcctatcccctttattctgttagttgtacttcagtttgctttcaggaaccactacttttccaactacaattctcagtgatttagatacactgactgctctcctactccagggctaagctcaagacccaggtttggcaaatgagtacatcacagctgctctagcaagggaataaattcgccaatgaccagatgacccagttggttaagtgagtttcgctccctggactatttctggcagggaactgtcagcctgccctgttcaacattttcttccttagttttatctaggaatgtcctgggatcagctgaaaagagggaggaggtggggtttggggaggagacatcctagcagcagttaatacaggaaggagaacctgaaatttttcatctgtgggtatgagaagacaaggtttccacattcctcggcagctcctgcacctgcctggagcaactttttgggtatagccatttatacataggctaggcaaccattaagaatcagtggatcagccaggtgtgatggctcatgcttgtaatcccagcactttgggaggccaaggcgggcaggttgcctgaggtcagtagttcaagaccagtctggccaacatagttaaaccctgtctctactaaaaatataaaaaaattagctgggcatggtggcatgcacctgtaatcccagctacttgggaggctgaagcaggggaattgcttgaaccagggaggtggaggttgcagtgagccacgaagacgccactgtactccagcctgggtgacagagcaagattcagtctc

SEQ ID NO: 67497 - DNA, 451 bp, Homo sapiens
tgctcgataccccgtgaaagcacaccccttgtactcgttttgttctctgaatgcagtcatcaaagatgactttgacatgggtggttagaacatcaaggtgtgtttcgaagcctgttggaatacttagtttggggttttttctgactgtgtacataaagaatgtttttgtgtatggcatggttttgtttacatcatcatacttctgaaattcattgcctggcactcttccagcttgattttgcatgttttaaaaagattcttgtcattctaactctaaattgggtgtgctgtattctagagctttgattttgtgtctcccaaagttgacgactagtgtaagtctgaatcagacagcttttgtttgaatcgtctgctcacctcacagttaatgagataacagtgaaataaaaataattaaaataacagattgaaaaaagagaagttactgaga

SEQ ID NO: 67498 - DNA, 640 bp, Homo sapiens
gaaagattggagacatgggagggaagtcagcctttagggaaattgtaatgtcatggaaagagacgccttctttctgtcccctcatggagactgtgtcctcatctagaaccaaaggagaggggctccaaaagaatcaccagtgaggattgggtgtgcctgcaggaagatgggactgacaactccctggatatctatctgtttgggcagcactgatctgctctgccctattgcttcctgcacaaaggagaacacagatggagagagacagcactggaggggctttggatggtgtggggagaaccttagatgaagaggggctgaagttgcttccccttatcccttcctcccaccttgactttctagtcccagattggagtacggcaaagaagtgtccatcagagaggagtgtggcataatgacacaagctaaccatctgctggaagatatagcaaatgtgtgaggggtcacctgttcctgggaagatgcctggaatcctccaggtgtgcaggttgtttgtcacctgctctggcttcatttctgcttgtatttttataaattgttttgtaaaaagtagatgttattttatccttcatctcttcccagagcctaaacaattaaagtcattttcagatcaaaatgt

SEQ ID NO: 67499 - DNA, 416 bp, Homo sapiens
ttagaagtagtttattcttatgtaaggaataactaagactttttggagtcaggcatatatatcaacttcagacaaattagtcttggcaataaaatacaatagtaacaaattgagaaatttgcctcaaactggtccatgtattctattaaaagtaattaggtttaatctctgtcctcatagaatgcctcttacattctttaacttatttttctctggcgttaattctggttctgccctcctttaactcaagtgtggaatgttggaaatgcctctttagttggtctttctgcttgcagtttcttctttgaattaatactacatgccaccaaagcacctgtaaaaaattgttacctgttgacagaggaaatttacacatgtctgcacattccaagtcctaagtaatctgactgtacttc

SEQ ID NO: 67500 - DNA, 434 bp, Homo sapiens
gatggtaaaggaaaggaaaggaaaggcttgtaacaaaggctgccacccattgtcctgccctccgcacggcctggtaacgtccctccagcctcagaaaggccgtctctgaactcagtgattcatgcccagaaatgacactgccatgcagttaaagcaggacttgagctggctcaggccagtaaaacaagagcagaaaaacaagttctgtgagcccgaaagtccctactacgcagttgtgtcccttggtgtttgggtttcaggtttgtcttttgttctcagaatctgttttcatgtgaggcaagagcacaaacaaaaataaaaatgagttcttatgggaatacttacaagtctgtttctgtcaggggtttacatcagcagtttatttttttaatgtgagtgactcatcatctttaaacaggaggggagattactgt

SEQ ID NO: 67501 - DNA, 528 bp, Homo sapiens
aatagttcaatggaactgaaatatattcatatatttagggaatttagtttatagttatagtgctatttcagatgagatgagttttccctaaatgatactaggacaattggctctccatttggaggaaaaaatttagatatgtatcttatagacaactataatttctaggtgaattaaatgatctaaatgtaaaaaaatcagaaaaatactaggagaaagtatgggaaacattatgacattaagatggaaaagccaaaggttctcctaccgaaacacagtgtttacaagatgaatgtcacgctgagagatagaacatctataagagaaagggtgaacatccagaatgtatagagttcttacaaattgattacaggaaagacaaaccagtagagaaatgtacaaagactaaacagctgattttcagaagagattcaaatgactagttactatggaaatagaaactaaaaaacgtgactatcaaattgtcaaaaaagaaaagtcgacgcggccgcgaaattagtaatagta

SEQ ID NO: 67502 - DNA, 183 bp, Homo sapiens
agcaccatcctttcttcattcctttttcacttatccatcattaggttgttactttttctttcagctggccccttccatccattcctttcctcaacaatctttgctaaatgtctgacacaagccaaaacaatgaaatgcaatcctgccgtaatgaaaactctaccgtggccaatgaatgcaggt

SEQ ID NO: 67503 - DNA, 378 bp, Homo sapiens
gccttttgctgtcacagtctgtatcagaaatgggcatgacccaaggagaactgagatactgtgggaagtctaaattctcttccaatatgagggacccccacacccaaggtgcctcaggagatggaaacctcctcagtaactctggtacaaggatggcttttgtcatccaagctttattcactgaagatttggtaaacaaggtattgtgtgtgtatatatcttattttctcatctgaccttgaattaagtcagtaacaggctgtactggatccctctgtgctcataaaatggattcaccaaagaactgatcttattcaaatagatcaagacactaaattcccataaactcttatacccagcctctcttcaaccagaaat

SEQ ID NO: 67504 - DNA, 343 bp, Homo sapiens
agtatttgctttacctacttaaaaaagcacaacactatatttattttttcatacagtctgatattttttctcttttaattggtgagtataatgcattcatatcaattatgattattttggacttctccccatcattgttctgggattattttgaattgttctttcccctattctgatgttttttttcccactattttggtaattatattcattaggcttatttttagtaattatatagcttttaacctgcatacttaataacatatgcagaatatcaaaatactcaccctcatcctgaattataaatgtcctaagagtgctttagatctgactgcatcttacg

SEQ ID NO: 67505 - DNA, 124 bp, Homo sapiens
tcacagtttttctgcatcaaatatgtattcattttgtagctgaaaaccccattttaaaagggagtggggatacattgagcctgtcaaagtatttataaaagtgtcaaaagattatttcatctgt

SEQ ID NO: 67506 - DNA, 471 bp, Homo sapiens
tgcccttttccctttgtcaatactacagaattttccaatactatgaatactatggtttcttcaatcctatatgcagatggctcccaaatctgtatttacacacacctccctcctactgagcatctcaacctggggttttcatggacacctgacccctctcttttatttcttcttttagtcaagagtatcatcatccattcaggctccaaagctagaatcgtgtgtctatatataatcagtcagaatgagatcaaccacaaaaagcaaccccacaaagctaaacatcagtcaggataccatgaggcgttgagccttagggagaaaggcagagatggaaggtcagcagccatcccaactcctcctccttaccataatttagcactgggcactgtccactgtaacctcccatcaccacactggacaaagcagttgagctgctgttccacacagttgctgctatccactctgaag

SEQ ID NO: 67507 - DNA, 311 bp, Homo sapiens
tttttttaaatagagacagtgtctcactatgtttcccagcctggtctcgaactccttgtctcaagtgatcctcacaccatggcctcccaaagtgctgggattataggaatgaggcacttcattcagcccatattagatatatttcaaaggcatattaggtttattaacatgtagcaaactacatgttaatgacatgggacaaagaatctagtagacattttaacctttagttatgtcttttttgaaccagaaattagctgtagctaaaaagcagtttattctttaagccaatgcatattctccagctgcat

SEQ ID NO: 67508 - DNA, 364 bp, Homo sapiens
cttcttcagggggtctgacacagaaactgtgtccaggggagattctcagtgtggtaagggactgagtgcgtcagggactccccagcagctgagggcctctctctccctgttgtgctcttgctggggctggtgatccaggggctcttaccccttggaagccgggtggaacatgagttccaccaccctgttgctgtagccaaattcattgtcgtatcagaaaatgagtttgaaaaagtggttgttgaaggcagtgccagccccagcatcaaaggtgaaggaatgagtatcactagtaaagttggaggagacaacctgttgctcagtgtagtccagaatgcctttgaagggaccctccaatgcctgt

SEQ ID NO: 67509 - DNA, 347 bp, Homo sapiens
agatatattttaggactgttttttccagatatgaaattttaatgagaaattttttaaaaattgggttatatttacataatggtgtactatgcaacaatgagaacaatctgtgactacatgcaataatatgaattaattgtgtaacataatgttgagcaaaataagccagcttccacttctggcttaaaagacaaaattaatatatgctgctagaagtcagaagagaaggataatgactgtaaaaaaacatgagggagcttctgagtgaggtaatgtgctgtttccatatctggtgctaattcaaatagctatgtcaaatttgtgggaattcatcaggtgctacaatt

SEQ ID NO: 67510 - DNA, 488 bp, Homo sapiens
tcttgaagtgtaaatacaatgtcccctcttcaagagccctaccatgaccactgtattgaaaataaacacacccctctgttgttacagtttatatcatgaccatctaacattataccacattgtactgtatataattatcttcttttctctgcatcccacaccccatctacctttaggcataacaatgctttcaaggaggccagagacctcacctgtcttgttctctgctgtatctccagcatcttgcccagcacctggcagaatgtaggtgctcaaaaaatatttgtggaatgaataaagggagaaaacgttggaaatcagtatgctgcagtgaaaatggcaaaggcaagctctgggatcagacagactaaggttaaaatcactattggagttgctaagctggtagtgtgtaaacccaatactgttcacggccattgattccactggaacctgcctgtcagtaaagccaacctgtgggatgaaagaga

SEQ ID NO: 67511 - DNA, 522 bp, Homo sapiens
gtcatgatatttgatatggtaaattcctcctgtttgtgattgttttcaagattgtcttgatatttttgtgcattttctcttctaggtaattttataactagcttgttaaatttcataagtaaattcttctgcagttttatgggtgcataattgtgttaggctcaagcagcagctaaagaaaacccaactaccagtgtcaaaacataatgatgatgatgatcatgtttgatgacggcagctttgtactaccagcagttgtttgaaccacatcacttaatcctcacaacaactctgtgagttagattattattcctattttacagatgaggatacgcagcacagagaagtaaaataagttgctcagtgttattcaactaggaagtagcagggttgggttcaacctgaagatttctgtgggctctctagtctgccacattgttggctatttgtgtacagccactatgttgttttcattactgcagctttatcataaataaattagttaatatttatgacttcatt

SEQ ID NO: 67512 - DNA, 208 bp, Homo sapiens
ggaggatcacctgaggcctggaggtcaaggcccagatcataccactacactccagtctgggcgacagagtgagaccctgcctcaaaataaaataaaaaccagattcctgggtgggacctgagattcagaatttctatccagccctcaggcagtgtggatgctggaacagtcagacactaaagatgagatagctctctgcctttgggaa

SEQ ID NO: 67513 - DNA, 429 bp, Homo sapiens
gtaattggctgtcgggggcagagtttgggacagaccatgggaaaattttgcatgtttccctagaccgttgatcatgaaagccaaggcctttggcttccgggccatggggcagaaaacggtcctatgtatctgactgaagacaaagacactttgcttctcagggatgtgtgcacgccaaaagcttcttcccttggaggagagagggaatcctctcatgccctgcatcctgaattgtagtaaagtaggagtctactactctttctctctagaccccttacaggtacaagtgtcatcagaaagaggtttaagaatactgagaaatcactcccttcaaagcctagggctgaagagccttagagcactgggagctcatgtactgctccatagacccagggccacatggaatcaatgcagccctcttaggtttct

SEQ ID NO: 67514 - DNA, 2576 bp, Homo sapiens
aggtgtgtgtgtctgagggtgtgtgtgtgagtgtggctggccccagtacctggccaagcccaccacttccacctgggccctacacccccacaatgtgtacccctcttatctgccctggagcctgtacagccatgccacgctacccctgagagtctagaaagctggtcactaactttgcagacggatgagccttgagcacccagaggagactggggctgtcaacgctgccccttgtcctgccggcttggatcccctgacagggtccttctaggcttcagactggcaccctgaccatggaaccctgaagtggcagtgacttctagagctcagtggcagaccccacgacccttcctcccccttcctccccctcccaccaccagctttcaagctcccagagggaggggtggggaggggatcctgatctcacagggcagggggcttccatcatgatgctcaactcagacaccatggagctggacctgccgcccacccactcagagactgagtcgggcttcagtgactgtgggggcggggcgggccctgatggtgccgggcctgggggtccgggagggggccaggcccgaggcccagagccgggagagcctggccggaaagacctgcagcatctgagccgcgaggagcgccggcgccggcgccgcgccacagccaagtaccgcacggcccacgccacgcgagaacgcatccgcgtggaagccttcaacctggccttcgccgagctgcgcaagctgctgcctacgctgccccccgacaagaagctctccaagattgagattctgcgcctggccatctgctatatctcctacctgaaccacgtgctggacgtctgaactcagcctgtctcccacctcccgggcctctctggggcccctttccaccgctcactgcttagaaaggccgcatcctccccgagcccttataccttggcatggagtcccaaaggccctgggcacaggcagagagcccaccggctggtcatgagggcctcttcctttctctgacccaggcacctcgagggctattctcctgggttccttccggggtttattgctgaggcccagctgtgcagaattgtttgctagtgtggttggtatggaatccttgctggctttactaagccagccacacttggagtctgcccccaagctctctcactgaatgctgcctcttctacccctatgtccaaattttcagccaccacagacctcagctgtgtatcctatctgttctagcttctcctgcccctggtggggatgggctgtcagaattgcaagggaggaaggctggggttagagtggggagtgggcttcttcctccaagatctcagtctctcagtgcttggcagaggggtgaggccctggggaggcaggggttggtgccctgactcctgtgaggggaatctcagtagctgggaattatggaaaaactcttcctgtttctgtccatcttgttcctgtggcttagcacatacagacctcagatcttacttggtagtgagtgccttgccctctttgagctatttggctacttccctgtccctctgactcctactgtcccaattttctccctccctgtgtgtcactagagaaaaaaaaaaacaaaaacctagattccggattaggggatgacatcccaaacagcccggagtatttgcagaaggctcaggcaacgagtgggccacatctcacttctgcttcctcatctcagcccactctgaaaatgtgcagcaccctcactggttcctccccccaacgcaaggaggatgcccaattgttgccctctaaaaatgcacagttctcctggccctaggacttacttattacatttttttctctttccttgagctgcctttggcaagggaagagacccccaactctgcgcccctactccatgctgctgatccccacctgcgcactatagcgcagggtcagcagtggaatgaagggccttagaacctgcatagaagaaatgaactcactgcatttctgtgctccctcctccctcgcaccaaactcctagctctacaagtatatttatttatttatttatttattcatctatttatttacttatttatttatttatttataaatattgctatttattgccgagttgtgcactttggggtagagtgaggggctcccagcagctctagctgggtctctcttgcttcctccctgcttacgcctttccttttcttgctccttcttcaactcctggtgtgtgtgagcatgccctttgcttgccacaccatatcctttccccagatccacctgtcctgacactctagtcctccaggatagtgctcctcccccagctccagggctcctggatgtccttcctcaactccctccacccctagacaatcctacctggtcccatctgcctcttttctctccccagcctgccctgtgacccttgcctcttcctgatactcccaagagcaggccccaggggtctgtgtcacatatctctgtgtgattccttctggttgcatccccaatttcatacaaaaagaaaaataaaagtgacctcgttctagcaccaggtatggttgt

SEQ ID NO: 67515 - DNA, 168 bp, Homo sapiens
ttccaatgtattgagagtggcaaatcctttaattgtagctcacttttaaaaaaacatcagataacccacttagaagagaaacaatgtaaatgtgatgtatatggcaaggtatttaatcagaagcgataccttgcatgccatcgtagatctcacattgatgagaaacct

SEQ ID NO: 67516 - DNA, 494 bp, Homo sapiens
tctttggaatgggtggaggtggttaatttttttaaaaaaataacaaaacgggtaactctcacgtggtaggatattcttaattcagcacagataaaaacatttttgattgtatttttcttatttctctaccttcataaagagagtacacgcccttcctttcccaataattcaagatcatttttatgatgtagctctaagtatatttgaggatttgttttcttttgcaaaagaccaagggaaaaactaaaaaatttatagggcacattttaaaactatatatataacacacacacacgtatattctggctttttaaaaaacaggaatgtatttgcaactgtgctaggtgtttttttttttattactaaggttgttttaggggggaaggtagggggagaacaaggaggaccaacattacagaaacttccctagtatgtactgctgtatttgagtatgatgctacacttttcaacaaattttgttgatcaacaatata

SEQ ID NO: 67517 - DNA, 181 bp, Homo sapiens
  misc_feature (17)..(17): n is a, c, g, or t
  misc_feature (31)..(31): n is a, c, g, or t
ttttttgtttctccttnctcctaaaagtttntgaaaccccttaaaaaaaaaggggttgttttaggggggaaggtagggggagaacaaggaggaccaacattacagaaacttccctagtatgtactgctgtatttgagtatgatgctacacttttcaacaaattttgttgatcaacaatata

SEQ ID NO: 67518 - DNA, 546 bp, Homo sapiens
tattgcagaaaatatcatgaatgtatgagtatctttgcacacatattattacatctgaggaatagatccctagaagtagaattgagaaacaaaggacataagccttaatatcctttatataattcaacaatcctttatataaagcctttatagcctttataattcaaatttggtaaattttttgaaaatgattccaaaaaggctgtaccaatttacagtttctttatttaaaaaaaaaaaaatttggctgggcatggtggctcacacctgtaaatcacagcactttgggaggtcaaagcggcagcattgcttgagctcagcagtgtgagaccagcctgggcaacatggtgaaaccctgtctctatatttttataaaaataaaaataaattattaaagttatgtctctcttaccctttgctttaagctaacaaattttaatattaaaaaatagcagagcgtgacccctatctttgctattccaaatttcaatattaaaaaataatacaggaagaccccatctcaataaataaaggtaaatataaagt

SEQ ID NO: 67519 - DNA, 492 bp, Homo sapiens
ggcgtgagccactgcgcccagccaagcttcattttttatatacaagcttgttagcagatgagctgggacatgagtctagttctccctgctttcagtctaatgcctgcttcctactgcccgaacaaataaagtactaattttacagtgtacggtctagaaaaaacatacattcagaagcaggtaagattttcagcagccccaagtcatgagggtctcctacaggggcagagaagtagtaaaaaaacaatcatatgcagttgggtagcccgtatagaatgtagactaattatattcaaatcctgcctctgccactggccagcactaggatctgggacaagttacactacttttccaagtccctgtttcctcttttgaggaaaagagaaaataaaaatacctctagatagggttattgacacagttaaattaaatgagataaagattgatttttccccagacatgttcattccctagtcatccatctcagtaaat

SEQ ID NO: 67520 - DNA, 344 bp, Homo sapiens
tttaaaatccacttagctattctatcttttgattgcaaagtttaatccatttacatttaaagtaattatatattgataaggaaggacttattatagccattttgttaatagttttctgttttgaatcttttttgtccctgtttttctctcttgttgcttttgatttctttctcattttcttttgcatatcttctatagctatagttttgtggttaccatgaagcttacataagacatcttgcagttataataatctattttaagctgataataacttaacttcaattgcatacaaatactctactcttttactcttccccccacataagaactttatgtttttg

SEQ ID NO: 67521 - DNA, 336 bp, Homo sapiens
ataagagatatgaagtggcacttctctgacattcactgctggagctattatttttgcccatggttattctgatttaacctatatattattgactaggggaaaaagcgtactgtaaaatctgaaagttactacagtatagtaaaatgccaagtttgtgaatttaaatctgcagaaatattaggcattgcatttagaaaaaggcaagttacctccatctgaaatataacaaaattttagattctatggtattaattatcatcctagatgtagatttatgaagcagtatgtcatgccagaggtttggttttattcaatattttaatacctattacgtac

SEQ ID NO: 67522 - DNA, 2130 bp, Homo sapiens
agggattgtcctgacaacttgtggggatagaagggctcacagggcaggggtctcagctgcccccatccttagggcaggggagttagtgtggagccgagagcaggtcccagctccccctgccagccgcactgtcccaggcccagggacctctgccgggtcctcccagcccttgccacacagcctagacgtagtagcctgggcttccagcaggtggcgagctggttcgtgctggaaatttctcctgggtttcttggggtcaaacatgccaacctccaagaccccatcctcacgtctcccacttttctggcgctggagtgtgcagggcgtaggacctgcatgtgtgggtgtgagaatgggggcggtggacaccaaggggcgagtgtgtgactaggtgtgtgtgcacatgtgtagggtgcagacgcatgggtgccatcctttgcgttcagtgactgtgcgtccagacccctcaccagcggcccccccaccacaccctggtcctcccaggcagctgtcccagggcgcccaggcctgccttgcaccacagccctcaggaaatccggcaaggaggcccctgcaggttggttcaggcccccaggtagcaaaacagagacaacagcagccccgcctgaccccctgcccctctctgtggaggcccgggacccccgcaataagcaccacatgggtgaggctgtccctgtcagggtcccctgccagggtccctcctggggttctgggccatttgaggggctctttgatgggccaggccggccagagtgaactccgagcactttctggctggtgccccaacctctccactccccactcattcccaccttgaaaaagggctataggtcccctgccctgcccgggtccagtttacaaacagtgtggggtggccccagggcctggccccactctccctgctgtgcccactcctctccagactccacctccccagtgggtatgggccctccacatgccaggtaagtagcaaacccccactccctccaaggaccaggtctcagagaaggccctggtcactgcccccggcccacctggagcccatcggggctgcctctcccagccgcgacttctccttttgccttaggcctcgcgacatcctgatctctcctgcaataactaggaatcgagattccacagtagacgtcccttgccgtgctcgctctctctctcgcgcgcgctctctctctctctctctctctctctctctctctctctctctctctctctctctctctctcctctctttctctctctccctctctctgttaagatcctgttcgggagtttccccagccgttgtagtatctagtatgttagagttgggaggggaccatagttatgtagcccagccccctcattcccagaggcacccagagggccagcctccagcctgaccccagagcagaaccggaacaccaggttggggccctggtgctgccacctcctctgctggtcgggctgggaccctttgccccttaggagaggtgttggtcacagatgtttacctcagtttatgtcactgtcgaagaaacaaaaaataatagcaaaaaataacactgtagacatgaagacttagaagacaaaaaaaaaaaaatcacacaaaaaatctcccttgttgcgattcttctgtgaaggtacagtgtgtatgtgtgtatgtgtgtatgtgtgtgcgtgtctctgtcccagaccctgtgtcccccacactgccccctgtccttcggtgcttcccagagacccctctgagctggcctgtggggcacgggaagccccctggatgggaggcggggccacaggtcggctagagggtctccaccaggcccactgaacagaaccccacggctgccagaatgttccctgagcccacactgtggccagtgggacagtcctggtggctgacatcagcgtccatgcttggctcagggcctggggcggggtcctgggtagagtcctagccccagagccccagcccctcatgtcttgccgcccttcctccatgtgtttgtaaatactctggcatcctttggccctgagaaggtttttaaatgtgttatttacttctctaaacatgacgattgctataaaaataaacaaaagtttagaaaaatg

SEQ ID NO: 67523 - DNA, 1053 bp, Homo sapiens
aaaaagcctccttagattcaaactggattccgacctcggttccactggtcaccattcaactactgttcatctcttagtctctgtttctgtaacttcaaaaggaagttagcattttccttgcagaggtgctgaggattgaatgagagaatacctggaaagcattaggcatgtagcacacttagcagatggtggttggctccctctgcttttccaccagtctgtggcctacagtttaaatggtgggaagaaggacatgagatctgaggctggggaaggaggtatggggttctaggcaagggaggaagcctcttaggcctggagcaagggagcagggtcctgggcaggtgacagagccccacagtgccctagctaccctattaatgggcccagaacctggaagccagccaccatgtgccctcatgcccagggtcttcctgcaggtggagatgaagagccaagagtctcagagtctgcagcagcagtgagactagtacctgggtcacctgcagcagtacgtggccacctatcagcagctgacctctgagaaggaggcgctgcacaggcagttactgctgcagacccagctcgtggaccagctgcagcagcaggaagcttggggcaaagcggtggctgagattataacattttaaaatatgaatacagtagtttaaaacaaagaaactggaggaaggaaaagtagagaaagagatgccaattcaagtccaaacctttatttgccaagttttcttagaatgacttttaccaattgatgaattcctgtaaacagaatgtataatggaaatacggaaacactgttgcctaaagtgggattattcactgctactgtgatgctactgtaatgtaataaattattaaattgttgcaaagtgctgtttttgccttaaaattttatgtgtcttgaaaactatagtattaagagtattgagactgtgaaaatgctggggacagttggcatgagataatcagtttttatttttatgaaattgtaatgtaactatgcaagtgtgtttattaaaggaacaaactaaaaag

SEQ ID NO: 67524 - DNA, 465 bp, Homo sapiens
caaaaacaaaaagatatgaaatttaatgtgaatggactatgaaagtttttaccacctagagattttcagaattagaatgcattttcttcttttaaaatactttatcacctgttgaaatatgaaagtagttgaacaaaagcttttttatttttcactttagatcttatcatatttgtaactgtgagcattttttgtaaataagattttcatgacctaggtcatattctacttgtttttaaaatatagaatatatttaggtatataaaacttaaagctttttgtatcaccataatgtgtgcatgcacacatacactgaaataaatggaaccaaccataagataatatctgcaatgcttggtaatcaaaagtttttatttttatttttatttatttatttatttattttttttgaggtggagtctcgctctgtcttccaggctggagtgcagtggcgcaatctcggct

SEQ ID NO: 67525 - DNA, 1757 bp, Homo sapiens
ggggactacggagagctctgcagggagccgaggcccccgcccgggccaagggagcttctgtcccgaggaccaggggatgcgaagggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatttgcttagtttccgtttgggctaatcttccggggttcgtaggaaaccttt

SEQ ID NO: 67526 - DNA, 5406 bp, Homo sapiens
ggggactacggagagctctgcagggagccgaggcccccgcccgggccaagggagcttctgtcccgaggaccaggggatgcgaagggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtccgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaaatggtaacatttttcaatagcgtgtgtagatagtatgcactatatacatcacgttaaagtaggactatcacacccagcccatgtggctaaaaaagctgaatcagacagtggatgagacacacaacggcagtgaagaaccgatacacttggcattgacgtctagctatgctgtatctgtgctttgcccacatgcccttggtgacagctgagcacccagctctgtcttggtaggtttgggctaaggaacaaatctctcctttgctcgtggttagcaagatacactcaagcatgaagataaacacagctgctttcttcttacaccccggtctcatgctccttaatggcgccatgggtgcttgttgggcctttttccagtaaggaatgatattgctgaagaatctacttaaccctgacaaattttaattataatctcttcttatacagataaaacatgactcctacaaggccccaaggtttacatagtctgaagtgaagtacagagctggcatctatctggtgatttctagctctcgagatacccaagcagcctgatggggcagttccccttcttacggttcacgctctaaggcaggatgtggcttatgagatactttgcattgtctgtctgcacaccttgaatctgcctgctggctcccttactttacctctctgtcatgtgcagatgaaggctcagggtgctagaggattagtaagatctctttctaaagacaggagagattatttacaagaagaactcaccagggtttagtttgcatttaagaattgccagtcttttgtcctgcatcatcttgaacattaatccacatgtttcagagctcaccagggcagtaccaatgctcttttcacagctatgaagagctagagaaattcttgttatggtagaaaaatttcacgattcatttttgaaactgcatttgtgcgtatgcagtgtagattttatagtgtgttgtgctttcaagatctaaatcatatataataaattaagggacaatggggctgacagcactaaacttggtgcttattgatattctaagaaatatctgtgaaatatcatcacgtatgttatacaaccttcatttaaaaaggtttaaaactagttagattcactttgacacttttcatatcatttcttaacccaagtgacgaaaacattgtccccaatgaatatactcattagaattaccatttgttaatatcactcattaattaaccccataattagatccattaatttaaatgatttaaatttaagtaagttttataaggtctgacatcagaggtatcttactttcctctgaggatgatgtacttgccctgaccatgcattttaccatcacacatgttcagaaagggccaaattcccaacctgctcatttttttttttatcagagtcatgatgaatcagtcctagaatgtttcatttgcacaagtagggctgcctccaagaggaacctctgatttattttgtatgaaatatatgtgaaaggatatgaatctgagagatgctgtagacatctgtcctacacttgagatgatttccaagcctctctggcactttgagttaagtctatctggtattaaatgccaaggaccttttgctgcctaaatccactctgcaggaaataggcccaaccaccagatgagaattaggccctggatgagtagcgctatagttactgtcctgttgattaatttctgccatttcatgtccataaaagagaccacccatatcatgcacacaattagatttctcacactctaactgtatatttgtatgatattttaaaatctcctaaatgctgggcaatggctattaacaattaattgtcttgcactggccttctgatgaaatgttaacaatgcctattgtaatatagaaaaaaacattctatctactgatttgggctgaatgtatgtaaataggtttctaaaaagtcagatgtttgagcagtggcctacaaatcagtaattttcggatgggagagtttctttacattgccgtggcatcttaaaagctatcttcatgtaaattgactgtactaggcctactggggatcagagttcccaagaaaggaaaccttttcttgtatctggattcaaatttatttccaatgtttcaagcgggaaacatgactctttattgtctgtaaatctaacattattacttttcctcttagaagaatattgtattgttagatgtttgttgagctggtaacatcgttgcaaccactgcaatatcttcgttagtaatctgtataatactttgtatacaagtactggtaagattgttattaaatgtagcttcagtcattaaattactatagcaaagtagtacttcttctgtaatatttacaatgtattaagcccacagtatattttatttcaatgtaattaaactgttaacttattcaaagagaaaacatctcatcatgtctattgtccaaagttacctggaatcaaataaaaattctagattaccatgaagaacataaaaaaaaattgaact

SEQ ID NO: 67527 - DNA, 5516 bp, Homo sapiens
tcggcttatttgttttccctcctcttaggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtccgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaaatggtaacatttttcaatagcgtgtgtagatagtatgcactatatacatcacgttaaagtaggactatcacacccagcccatgtggctaaaaaagctgaatcagacagtggatgagacacacaacggcagtgaagaaccgatacacttggcattgacgtctagctatgctgtatctgtgctttgcccacatgcccttggtgacagctgagcacccagctctgtcttggtaggtttgggctaaggaacaaatctctcctttgctcgtggttagcaagatacactcaagcatgaagataaacacagctgctttcttcttacaccccggtctcatgctccttaatggcgccatgggtgcttgttgggcctttttccagtaaggaatgatattgctgaagaatctacttaaccctgacaaattttaattataatctcttcttatacagataaaacatgactcctacaaggccccaaggtttacatagtctgaagtgaagtacagagctggcatctatctggtgatttctagctctcgagatacccaagcagcctgatggggcagttccccttcttacggttcacgctctaaggcaggatgtggcttatgagatactttgcattgtctgtctgcacaccttgaatctgcctgctggctcccttactttacctctctgtcatgtgcagatgaaggctcagggtgctagaggattagtaagatctctttctaaagacaggagagattatttacaagaagaactcaccagggtttagtttgcatttaagaattgccagtcttttgtcctgcatcatcttgaacattaatccacatgtttcagagctcaccagggcagtaccaatgctcttttcacagctatgaagagctagagaaattcttgttatggtagaaaaatttcacgattcatttttgaaactgcatttgtgcgtatgcagtgtagattttatagtgtgttgtgctttcaagatctaaatcatatataataaattaagggacaatggggctgacagcactaaacttggtgcttattgatattctaagaaatatctgtgaaatatcatcacgtatgttatacaaccttcatttaaaaaggtttaaaactagttagattcactttgacacttttcatatcatttcttaacccaagtgacgaaaacattgtccccaatgaatatactcattagaattaccatttgttaatatcactcattaattaaccccataattagatccattaatttaaatgatttaaatttaagtaagttttataaggtctgacatcagaggtatcttactttcctctgaggatgatgtacttgccctgaccatgcattttaccatcacacatgttcagaaagggccaaattcccaacctgctcatttttttttttatcagagtcatgatgaatcagtcctagaatgtttcatttgcacaagtagggctgcctccaagaggaacctctgatttattttgtatgaaatatatgtgaaaggatatgaatctgagagatgctgtagacatctgtcctacacttgagatgatttccaagcctctctggcactttgagttaagtctatctggtattaaatgccaaggaccttttgctgcctaaatccactctgcaggaaataggcccaaccaccagatgagaattaggccctggatgagtagcgctatagttactgtcctgttgattaatttctgccatttcatgtccataaaagagaccacccatatcatgcacacaattagatttctcacactctaactgtatatttgtatgatattttaaaatctcctaaatgctgggcaatggctattaacaattaattgtcttgcactggccttctgatgaaatgttaacaatgcctattgtaatatagaaaaaaacattctatctactgatttgggctgaatgtatgtaaataggtttctaaaaagtcagatgtttgagcagtggcctacaaatcagtaattttcggatgggagagtttctttacattgccgtggcatcttaaaagctatcttcatgtaaattgactgtactaggcctactggggatcagagttcccaagaaaggaaaccttttcttgtatctggattcaaatttatttccaatgtttcaagcgggaaacatgactctttattgtctgtaaatctaacattattacttttcctcttagaagaatattgtattgttagatgtttgttgagctggtaacatcgttgcaaccactgcaatatcttcgttagtaatctgtataatactttgtatacaagtactggtaagattgttattaaatgtagcttcagtcattaaattactatagcaaagtagtacttcttctgtaatatttacaatgtattaagcccacagtatattttatttcaatgtaattaaactgttaacttattcaaagagaaaacatctcatcatgtctattgtccaaagttacctggaatcaaataaaaattctagattaccatgaagaacataaaaaaaaattgaact

SEQ ID NO: 67528 - DNA, 173 bp, Homo sapiens
ttgaacctggtaggtagagattgcagtgagccaagattgtgccactgcactccagcctgggtgacagagcaagactccatctcaaaaaaaaaagaaaagaaatatatgtgaagaaaagttgccaatttgtacttactgatatcttcagagaactcatttttaagaaaaacttt

SEQ ID NO: 67529 - DNA, 506 bp, Homo sapiens
tgactatggtccttacgctggattcatttatcttgaaatggtgaacaatcacagctgcagaccctcaatttatggtacatatcaagcaatttggctttttttcttgtaatgaaaaaaaaaagttttttttgctttttttcatgacactgcttcttgggagcactgccagcattactagtggcacttcgtatgggtcctaaggtgttattgaaggtttacgatattgcactaaacacgaaaaataccagagaaccactggagatactttttactgtgatatgtaatttactggagacaggaactgctcgtttggagatggttagcatcacagggtgttttaagtcgatacttgcaacccttgagctcaccacagtagcaacaggaggtggctaggaaattattcacagcaggacagtacgcactgcaattaattgtatgcagttatgatttaataccacatctttatgctcacgtttctctcaactgtgaatggtgccatgtacagt

SEQ ID NO: 67530 - DNA, 1414 bp, Homo sapiens
  misc_feature (2)..(3): n is a, c, g, or t
  misc_feature (355)..(355): n is a, c, g, or t
  misc_feature (670)..(670): n is a, c, g, or t
  misc_feature (829)..(829): n is a, c, g, or t
  misc_feature (961)..(961): n is a, c, g, or t
  misc_feature (988)..(988): n is a, c, g, or t
tnngaataaggtacttcataaagacatgagatataattatagaaatatgcattaaggaatagcacaaaatgcagcttctcatgtaagaacacacaaaaaaggattttaaagctaagcaataatagtatgataaattttgttgtgagtaccttctgaaaatgattatgctgtataaactgatttgctgtttctgaacatgttatttcaaagtcacttttatggtcttgtgccttattgtgttgtacataatgatatctccatttagcttactttacccacaccttattttctcctaattgctgtggaaaatatctattatatgacacctgtcaattaataagtatgcactcagcangttcattttttaggtaaagggttggaaggggatatagaagtagtgtttaagataaagtctctccctgcaaggagcttacagaagagataataatcccaaacaagtaatgtatggtagaagacattgtgtaaatagggctaaattggtttataggtgttataggtgtttatcaaagaggccaccactgatggctacgaaatcaccattggtgactctctttattctctagttggtagtaaatggcatcatccatttttacttctcatcgatgaaataaagtaacaagcctgcttgttagctaatatattaatgccngtatggcagccaaaatgtatttttgtttatagtcattttcaattacatgacatatttttaaaaatagttacaaaacttttatattcatatgactattaaagggttctaagtcctttggtatatcaaggacactaactaaaaacattttattttccttanaaattaaaatcaacaaatacagtaatttaaaacaccatcttgatatttcgttgtcgtttgcagttaatataaacatttctttggtcatccatataacgtatttggattttgtgtccttgggaatatataatntctacccttctcagtgtcactaatatntattcaggataaataaaaatcccaaaagaggaatattatagcactgatctcttatatactactgctatatatagtagaatgagaaagaattgcttttctctaagaacagtctatgtgtactttttcaggagtattttctttgatgaaagatttgtgtgtgccttgttaataggcctcaacgggctaaatacaacaggacaaccaatgattaacttttaaggcaataaacactttgtagtaaagtaaaaaaaatgtgttgcagataatagaatctatgcaaaatgtgtttgattttagattataaacagtaagtccagaaaaagagtaaaaaagatttctctttttttcttttgttagattttatttggataattccaccatggatatagataatatattatcattactcttacatgttttttaatg

SEQ ID NO: 67531 - DNA, 551 bp, Homo sapiens
agtacatactaagaaaagaaaaatagcccagagctgtctgagctatgtgaggtatgcaaaatttattagacccggacagaagtgaatactggcttccgccacgccttcccatgccttagggcaattgttaaaggcattttgttctttattagctgcctcacccattatctttatgttcctggaatttgtgatacaaggaagaaagcatagccagtcaatagcttaagttttttaaatataaattcttggtaaacaagttaagctctgcctcctctcctttccttaaaaaccggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagctttcagtgagccgagattgcgccactgcggtccgcagtccggcctgggcgacaga

SEQ ID NO: 67532 - DNA, 397 bp, Homo sapiens
gttggcaatgacttggagactgtctcatatgcctctgagacacagcactgactcagaatgacagtgccttcaccagaatcagaaaaagtcctgactgagtttgaattctaggaaccacttttcttgagtgtttcttgtacagatatccaaagtagagcctttgggtatttaaaaataatttgtaaatgccaaattaagagtttaaagggcactgtatgaactagttgtgtgtgtgtgagagagagagagagagagagaaggagagagagagagagaatgacagagaaaaagagagagagagaaaaggagagagaaagagacagagaaagagatagaaagagatagagagagatagaagagggggagagagagagagagaggagagagagaggtggag

SEQ ID NO: 67533 - DNA, 1068 bp, Homo sapiens
ggcgcgggagttggcattcggtggtcctggcagttagctgagcacgccctctgagccgctcggtggacaccaggcactctagtaggcctggcctacccagaaacagcaggagagagaagaaacaggccagctgtgagaagccaaggacaccgagtcagtcatggcacctaaggcggcaaagggggccaagccagagccagcaccagctccacctccacccggggccaaacccgaggaagacaagaaggacggtaaggagccatcggacaaacctcaaaaggcggtgcaggaccataaggagccatcggacaaacctcaaaaggcggtgcagcccaagcacgaagtgggcacgaggagggggtgtcgccgctaccggtgggaattaaaagacagcaataaagagttctggctcttggggcacgctgagatcaagattcggagtttgggctgcctaatagctgcaatgatactgttgtcctcactcaccgtgcaccccatcttgaggcttatcatcaccatggagacatccttcttcagcttcttcatcttactgtacagctttgccattcatagatacatacccttcatcctgtggcccatttctgacctcttcaacgacctgattgcttgtgcgttccttgtgggagccgtggtctttgctgtgagaagtcggcgatccatgaatctccactacttacttgctgtgatccttattggtgcggctggagtttttgcttttatcgatgtgtgtcttcaaagaaaccacttcagaggcaagaaggccaaaaagcatatgctggttcctcctccaggaaaggaaaaaggaccccagcagggcaagggaccagaacccgccaagccaccagaacctggcaagccaccagggccagcaaagggaaagaaatgacttggaggaggctcctggtgtctgaaacggcagtgtattttacagcaatatgtttccactctcttccttgtcttctttctggaatggttttcttttccattttcattaccacctttgcttggaaaagaatggattaatggattctaaaagcctaaaaaaaa

SEQ ID NO: 67534 - DNA, 1349 bp, Homo sapiens
gatcacctgaggtcaggagttcgagaccagactggctaacatggtaaaaccctgtttctactaaaaatacaaaaaagtaaccgggtgtggtggcacgtgcctgtaatcccagctactcgggaggctgaggcaggagaatcgcttgaacccgggaggcagaggttgtggtgagctgagattgcactattgcactccagcttgggcaacaagagcgaaactctgtctcaaaaaaaaattgtatttctgaagaattgttaagaacattggaaattcttgagatataatattgattggaaaaagatgaaactatatggtatgatctcaatatgtcctgatgaataaaaacataatacagaggacattattctgagataaaatacatcaaaatctttccattttatttgtatacttttacaatttttgattttttaaaatgtattctgatacacaaaataataaaaatgaaaaataaaaaatttggccgggcgcagtggctcatgcctgtaatcccagcactttgggagactgaggcaggtggatcacttgaggtcagcagtttgagaccagcctgaccatcatggtgaaaccccatctctactaaaaatacaaaaattaagctgtgtgtgatggtgcacacctgcaatcccaggtactcaggaggcttatgcgggagaatcgcttgaacctgggaggcggaggttgcagtgagccgagatcgggtcactgcactccagcctgggcgacagagtgagattccatctcaaaaaaaaaaaattgtagattcacattgcagtacaactgtgcatcttgcccattgatttctaaatgtattaactacttaaattaatcctgaatcttttcccaggcttaagtgggataatgttttattgtagatgcatatttcctggctctacccagtctttctttgaagactttatcatcctattttctgaatccagtggctgactttaatcttctctggaggaactagataatttctagactaatgcttacactcatgatccagattgtaatttctgaactccttcttccaaatagaatcaaaacaagaaaggggaaagcctctcaaagcaactgtgcgttaataatgaaacactctttttttctaatccaaggagggtttcatactttttcttagtttcttgccctcttcccttctgatcaataattgtaataggaaatttgcaattgtgccaatactcagattcaatactgaactactttcttgcattgtaattcaaattccaaggttaacaactaggctgtatgtttccaaaacaatcttattgtatatgtattttcttaggtgaagtttccagaaatgattt

SEQ ID NO: 67535 - DNA, 750 bp, Homo sapiens
tgcagagccaaacacacatggtaatttaaaaaaataatgcacgtatgtggtaaaaacagtaaaagcaaggtatcaagtaaaaagtgaagagtcctccctttctcattcccattcctactctctaattttttatatatccattttgtaagctataatacagagattccatatactcttcacatactttccccagtggtaacctcttgcataactataggacaataacacactataggacaaaaatcaagaaattgacattgatacaatccatcaaccttattcagagttcaccagtttaacacatgcttattgtgtgtctgtatttagttctatataattttatcacatgtatgctgatgaccaccaccacagccaagatacaaaacattttcagtgtaaagatttctcatgctacccttttatagccacagctacctccctccctccctgtacttccctaacccttggcagtcactaatctgatctttatgtcttgtcatttcaaaaatgctacataaatggaatcagatttgattgttttcattcagcacaatccctttgagatctatccaaggttttgacatgtatcgagagtttattcctttttattgctgaatagtattaatattctatagtatggatgtaacatagtgtgtttaaacattcgcctgttgaaggacacttgggttgtttccagtttcaggttcttacaaataaagctactctgtgtgttcatgtaaaaaaaaatat

SEQ ID NO: 67536 - DNA, 970 bp, Homo sapiens
gctacttgggaggctgaagtgggaggattgcttgagctcaggagtgtgaggctgcaatgagctgtgatcatgccactgcactccagcctgggcaacagagtgagaccctgtctcaaaataaataaagtgtatttgtcttgagaatactatgacttggcattatttggtgactgaaggtcatggaagggtctcgctgtgttgccaaggctgatctcaaacttctggcctcaaacaaacctcctgccttaaccttccaaagtgctggggttatagatgagccactgtgccccgccatggagtcatgtgatacacatagtaagctgtcagatatttttgataagttcaaatagacaccaagtaaaaaaagattcccatttattctccccagcttgccaaccccctaaattaagtaatgaaatgaaaccagcaccttttcagtatatctgacttaaaatcattatttattctgacccatttaactgtttgcaggattttttccctagagcagacagctataggcctgtatcattaaggattctcaaataagtgaactattgaaaccacataaaagccatcagttgcaaattctacttctctttgtttaagtagctaaaaatgaaagtggtggaaaaaacaggagataagcatattaagttctctactagtgctgaatctttaaatgactagctaagcagcgaagaagaaatcattctagaatgcagtgctctggatcctgctttgttataaacagttataatagcattaagttaacagtatttcacttaaacagctggacaggtggagaaaacattgtttcaggagttaggctttgtaatcttagacttgagggttttctcaatttctctttgtttatgataaagaaaaaccctattactactccctttgtttttggttaaaaactgaaaataactgattttgaaatcaaataaaccagtgtaatataaagcca

SEQ ID NO: 67537 - DNA, 661 bp, Homo sapiens
atcaccaataattttttaaattaatttcatgtgaaactttaaagctcttctaagaaccctttttcatttgttcgttattaaatcaaaacttcaatccagtcacctttaactctttcatgaccatttccacatgcccttaccgttggctatcttagcttgatgtgctaatcaagttccccctaatttgacatactagaatctaatactagaggcagcatgacattattatgggggaggaggttgagaagcactaacctcgaagttagaatttctggtttgtcatcccagtctgctaattagctttctgatttaagacaaaatactttttctgtgccttctgggggtcaaattcgatttttaagattctctcagttggaagaaatctaactaaaaatatacttaaaataattctttggtagtatattattttgaaatttggtccagaatcctatttgtttattcctgtagtatacatacatctgtagttacccagtagtctttgttgtctttgggccatctaaagtatatttgggctgggcatggtgtctcacacctgtaatttcaacactttggaaggccaaggtgggaaaatcacttgaggccaggactttgagaccagcctgggcaacacagcgagaccccatctctcctaaaaaataaa

SEQ ID NO: 67538 - DNA, 1368 bp, Homo sapiens
atcaccaataattttttaaattaatttcatgtgaaactttaaagctcttctaagaaccctttttcatttgttcgttattaaatcaaaacttcaatccagtcacctttaactctttcatgaccatttccacatgcccttaccgttggctatcttagcttgatgtgctaatcaagttccccctaatttgacatactagaatctaatactagaggcagcatgacattattatgggggaggaggttgagaagcactaacctcgaagttagaatttctggtttgtcatcccagtctgctaattagctttctgatttaagacaaaatactttttctgtgccttctgggggtcaaattcgatttttaagattctctcagttggaagaaatctaactaaaaatatacttaaaataattctttggtagtatattattttgaaatttggtccagaatcctatttgtttattcctgtagtatacatacatctgtagttacccagtagtctttgttgtctttgggccatctaaagtatatttgggctgggcatggtgtctcacacctgtaatttcaacactttggaaggccaagagggtctcgctgtgttgccaaggctgatctcaaacttctggcctcaaacaaacctcctgccttaaccttccaaagtgctggggttatagatgagccactgtgccccgccatggagtcatgtgatacacatagtaagctgtcagatatttttgataagttcaaatagacaccaagtaaaaaaagattcccatttattctccccagcttgccaaccccctaaattaagtaatgaaatgaaaccagcaccttttcagtatatctgacttaaaatcattatttattctgacccatttaactgtttgcaggattttttccctagagcagacagctataggcctgtatcattaaggattctcaaataagtgaactattgaaaccacataaaagccatcagttgcaaattctacttctctttgtttaagtagctaaaaatgaaagtggtggaaaaaacaggagataagcatattaagttctctactagtgctgaatctttaaatgactagctaagcagcgaagaagaaatcattctagaatgcagtgctctggatcctgctttgttataaacagttataatagcattaagttaacagtatttcacttaaacagctggacaggtggagaaaacattgtttcaggagttaggctttgtaatcttagacttgagggttttctcaatttctctttgtttatgataaagaaaaaccctattactactccctttgtttttggttaaaaactgaaaataactgattttgaaatcaaataaaccagtgtaatataaagcca

SEQ ID NO: 67539 - DNA, 1747 bp, Homo sapiens
atcaccaataattttttaaattaatttcatgtgaaactttaaagctcttctaagaaccctttttcatttgttcgttattaaatcaaaacttcaatccagtcacctttaactctttcatgaccatttccacatgcccttaccgttggctatcttagcttgatgtgctaatcaagttccccctaatttgacatactagaatctaatactagaggcagcatgacattattatgggggaggaggttgagaagcactaacctcgaagttagaatttctggtttgtcatcccagtctgctaattagctttctgatttaagacaaaatactttttctgtgccttctgggggtcaaattcgatttttaagattctctcagttggaagaaatctaactaaaaatatacttaaaataattctttggtagtatattattttgaaatttggtccagaatcctatttgtttattcctgtagtatacatacatctgtagttacccagtagtctttgttgtctttgggccatctaaagtatatttgggctgggcatggtgtctcacacctgtaatttcaacactttggaaggccaagagggtctcgctgtgttgccaaggctgatctcaaacttctggcctcaaacaaacctcctgccttaaccttccaaagtgctggggttatagatgagccactgtgccccgccatggagtcatgtgatacacatagtaagctgtcagatatttttgataagttcaaatagacaccaagtaaaaaaagattcccatttattctccccagcttgccaaccccctaaattaagtaatgaaatgaaaccagcaccttttcagtatatctgacttaaaatcattatttattctgacccatttaactgtttgcaggattttttccctagagcagacagctataggcctgtatcattaaggattctcaaataagtgaactattgaaaccacataaaagccatcagttgcaaattctacttctctttgtttaagtagctaaaaatgaaagtggtggaaaaaacaggagataagcatattaagttctctactagtgctgaatctttaaatgactagctaagcagcgaagaagaaatcattctagaatgcagtgctctggatcctgctttgttataaacagttataatagcattaagttaacagtatttcacttaaacagctggacaggtggagaaaacattgtttcaggagttaggctttgtaatcttagacttgagggttttctcaatttctctttgtttatgataaagaaaaaccctattactactccctttgtttttggttaaaaactgaaaataactgattttgaaatcaaataaaccagtgtaatataaagccatccatgtgttctgctaatcccttacttaaaacctatcagttgcttttgtgtattaaaggtctcctccacatgcttttgtcttcacttttgcctaactaacagatgtgcgagtgccagaggatcacccagagcctccaacttgctacccactgttttgccaccagagtgaatacctatttccttgtttccctcagggcctgggcagaaaagaactgccttggactggcagtcatatggtcatcccaacatatttccacttcaaagcagtacaaagtttccattgtttaagtttttcaaaagggcagagtttgactaggaatttttttttatcagttataatactatactattctttttttactcttacggttttttccca

SEQ ID NO: 67540 - DNA, 1082 bp, Homo sapiens
  misc_feature (1007)..(1008): n is a, c, g, or t
  misc_feature (1011)..(1011): n is a, c, g, or t
  misc_feature (1013)..(1013): n is a, c, g, or t
  misc_feature (1015)..(1015): n is a, c, g, or t
  misc_feature (1023)..(1024): n is a, c, g, or t
  misc_feature (1027)..(1027): n is a, c, g, or t
  misc_feature (1035)..(1036): n is a, c, g, or t
  misc_feature (1042)..(1042): n is a, c, g, or t
  misc_feature (1054)..(1054): n is a, c, g, or t
aggcgcagagcatgtcgggaccgggagggccggccggcccggggcgggggggactgggcaggaggggtcgggctcagggaactgcaactcccagcagcccccaggtacggggcgtggctagggacgaggctgggtcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagnnggnangnagtctttnnggntggggtcnncttacnggttgctcgtgnatgtccctgtcctcattgacgcgtgggg

SEQ ID NO: 67541 - DNA, 1017 bp, Homo sapiens
aggcgcagagcatgtcgggaccgggagggccggccggcccggggcgggggggactgggcaggaggggtcgggctcagggaactgcaactcccagcagcccccaggtacggggcgtggctagggacgaggctgggtcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacggtgagtcctcacctctgtgagctgccccacagtggcctcttagaggtatggccctcgcacacaggggcctgggtatctgaaccagcctcccaggctgctttgggcctgacagttgcatggatgagggcaggactggggaggcaatgggctgggtgggcatccagaccttagctccagcacttctgggaacctcggtccctgagcccacagcccttcatagctggatggcccaacttcagcttcactgcctactccagctgggaaaccaaggccagcacagcgccagccatcagagtgaga

SEQ ID NO: 67542 - DNA, 642 bp, Homo sapiens
aggcgcagagcatgtcgggaccgggagggccggccggcccggggcgggggggactgggcaggaggggtcgggctcagggaactgcaactcccagcagcccccaggtacggggcgtggctagggacgaggctgggtcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccggaactccttgtgggaagaagtttgcacctcggccctggctgcccaccatcagtgccccgcagtcagcagccattcctggcagtgaactctgccaggactgaagctgtggctttatccatcagctccctgggccttccccgcaacccacctcggggatctgaggatctggtgcatagatgaacatcatcccctcctcccccatacacacctaggcttgaaatgccctacaggcccagaactttctcacatctgaaatggaggcattgcaatgaaaaggcacccacagcatcatgcaagtggcatcttgt

SEQ ID NO: 67543 - DNA, 1324 bp, Homo sapiens
agttccgggagggttgggccagaggaggcggtcctggtagggagtgcgtagcagggtggagtcgctgtccggtcgcgcttcacttctgctccgccctccctgctccccataacagacccctccctccactaaggcttccaaacgtcgccccaagcctcccaatttctcgcagcccttcatgctcttctcttggccctagcaggagtggtcaccagcagtccctgtcccttggcaccaggagtccctgtagcctggctaggtaaggaaagggagttgcatctccaaataaggaagatccagttgtggccacccaattcctcctcttcgaaagacactttctgcccatcacctgctttctgtgccaggaccatctttactttctccacaaaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacacc

SEQ ID NO: 67544 - DNA, 1603 bp, Homo sapiens
aggcgcagagcatgtcgggaccgggagggccggccggcccggggcgggggggactgggcaggaggggtcgggctcagggaactgcaactcccagcagcccccaggtacggggcgtggctagggacgaggctgggtcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcagtgagtgcagggcctgggggagggccctcatgagagcagtgccctgaatgagagcgcctgacatctcttcctcgcctgtgtacagtcaaggtgcctagcacataggagaggctcaatacaagactcgtggggagggtgcgaggttatttaggaaaataagggaagattcaagcacatggagaaccaagttctgcatgataaggtccaaaaaggcttatagggcttgagctgagcagaagcaggggggaagaggtgtagtgatggtgctggaagaggagaaggaggagtttgctggccctgtcccctctggtccaggggtcctgggccctctccctgcctcactgctcccctctggacagctggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacacc

SEQ ID NO: 67545 - DNA, 1066 bp, Homo sapiens
aggcgcagagcatgtcgggaccgggagggccggccggcccggggcgggggggactgggcaggaggggtcgggctcagggaactgcaactcccagcagcccccaggtacggggcgtggctagggacgaggctgggtcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcaaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacacc

SEQ ID NO: 67546 - DNA, 535 bp, Homo sapiens
cagtccagccactgactctggggtatgcaccctgatgggaacccaccgggacctctttcaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacacc

SEQ ID NO: 67547 - DNA, 450 bp, Homo sapiens
tggtcaccagcagtccctgtcccttggcaccaggagtccctgtagcctggctaggtaaggaaagggagttgcatctccaaataaggaagatccagttgtggccacccaattcctcctcttcgaaagacactttctgcccatcacctgctttctgtgccaggaccatctttactttctccacaaaaggtaccttcaggacaggctgggactgctgggcttgggaaccatcttggaagggcctaggttcccacttacacccttgccatctagcagactgagttggtagtacagggatggcaatagcaagttcagagagcagcttaatatgctaggggtggcagaggggagagggagctttggtgaaatgtctatagtcagaggggtagtaaacagggcatctgagaagttctttcaagttctcccctatccatagggatacacatgttttgg

SEQ ID NO: 67548 - DNA, 1244 bp, Homo sapiens
aggcgcagagcatgtcgggaccgggagggccggccggcccggggcgggggggactgggcaggaggggtcgggctcagggaactgcaactcccagcagcccccaggtacggggcgtggctagggacgaggctgggtcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacacc

SEQ ID NO: 67549 - DNA, 1349 bp, Homo sapiens
aggcgcagagcatgtcgggaccgggagggccggccggcccggggcgggggggactgggcaggaggggtcgggctcagggaactgcaactcccagcagcccccaggtacggggcgtggctagggacgaggctgggtcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctcta

SEQ ID NO: 67550 - DNA, 1031 bp, Homo sapiens
  misc_feature (952)..(952): n is a, c, g, or t
aggcgcagagcatgtcgggaccgggagggccggccggcccggggcgggggggactgggcaggaggggtcgggctcagggaactgcaactcccagcagcccccaggtacggggcgtggctagggacgaggctgggtcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcaaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatcgctctgggaatngtccacccaagcccccatggcaagccgtgggggagggaggggcacggggggcaaatgattggggcacccggaaacccgc

SEQ ID NO: 67551 - DNA, 398 bp, Homo sapiens
agctctctcgagacctggctgccacattctcaccagcagccatgcccagtctgtcactcagttgggcgcccatttcataactatggaggccaaggcccagaaagctttgtgtcccctccctgcgcccagaataagatgtttatgtggcctccccacagccctggagcagatcctacagagcacagcgggcatatactgtgtaggagacgaggtaagctgtccccagacctccccaggcccagccacagtggctgcctccctcatgctgacctccctcaagctcagagcttcctgagaaggcgtctgcagggggatctctgtgccatggggcactcctcagctcactcccactaaaccgtcttaagagggagttactcaaggtagaagactggctgtga

SEQ ID NO: 67552 - DNA, 1192 bp, Homo sapiens
aggcgcagagcatgtcgggaccgggagggccggccggcccggggcgggggggactgggcaggaggggtcgggctcagggaactgcaactcccagcagcccccaggtacggggcgtggctagggacgaggctgggtcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacacc

SEQ ID NO: 67553 - DNA, 1005 bp, Homo sapiens
aggcgcagagcatgtcgggaccgggagggccggccggcccggggcgggggggactgggcaggaggggtcgggctcagggaactgcaactcccagcagcccccaggtacggggcgtggctagggacgaggctgggtcgagccagaggcgaccggaaggatctttctagtccagcccctcgctttacccggacgaaagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctatgaagcaggtgccaaccctgaagattgatggaatcaccattcaccagtcactggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagagtgtgcagtggaattttccagagactatatgacatgtgataccgcaatagaatgaactcagaagcagagctgagaatccaactgccttttattaagccaaacattaaagagatttatgtctctctttgtactacattctttgctttgaaaattagttgtttttaagtaaaaacatgttttatat

SEQ ID NO: 67554 - DNA, 1047 bp, Homo sapiens
gacattactgctagtttataggaaacataagcaacaaaaaacaaggcaattagcaccacaaaaaaacaaccaggtacatctagatctaacagaacattccattttacagatgactcagtctccccacagattaacagtattaagaaaggagaataaaggagatataagtgacttaataaccagatatgctatatagaccttatttgtatcctgtttccaacaaccaactgtaacaagatatctttgagatatttaggaaaatatgaatgaatattagatgatttttagagaattattaattttgctatgtgtggtaatggtgtgccgatttatgttttttaaaaagttcttcagttagagatgtatatttaaatatttatgtgtgaactgccatgatgtctagaagtttctttaaaatactctagaaaaaagagtttagggagaaagctgaaagatgaaataagattggcaaaatatggaaactattgaagctggatggtaggtacacggaattcattacattattctctttacatttgtatatgtttgaaaaatttcataaggtacacaacaaaataaatgacatggtcacctcagttattttgctgaagttttgtcaatcaccccctgcttagctggagtttaccttctagtatcattctcagcaaaggctcacaggaatgctattctctgaattcttacatattcagcctgttggcctgttctcgaattgaaggacagcttgtctggttcatactttctctacatgagtgtattgtaagcattacttcattgtcttttgtcattgaatattgctgaggtggccacagcctgatttctgatgccatctctatttctttctttattactaacaagatgttttatcctatattctcattggtttctttatctttcatgtccaaaaatgttaaataggccttcaggtaggtctttttggaacgatttttcctgctacaagtttactctttcattgtggagaatcattttcttatatttcaataaaaaagttggaaaattttcaactta

SEQ ID NO: 67555 - DNA, 225 bp, Homo sapiens
ggatttatggaagtgtcggcctgaccaatgttaatttccctttcctgacattaataacagcagcagcagctaccatctgtgcaccttaccacgtgccaagcaccgtcctgagtgccttctatggcatgcctctttcagtcctctccacaatgccatgctctgtgcactattattatccctgttttacagatgagaaaactgaggataagaggttaaataactggc

SEQ ID NO: 67556 - DNA, 471 bp, Homo sapiens
gaattgcggaagtgaaatcaaatacggtcgttttagaactcaaatattctttgcagggtaaaaaggtcccaacttaagcatatgataaatatatagccaattaagcatgttttcagacagtgctgtgctgactagcacctaagtattcccatcaccactgaatttcacagacaccactaaaacaagagaaactacctaaactgctcaataatcctaattactgctgcatatttatgcaagttggtactacagaaataggctctaggagaatcaaataatgcaaatactaaccacgtaattacttttatggttgatatatattcttctaaagcaattcttttacaaataaatacttcatttgaagctggaataagccgtttaaaaactgtaaccttttaactgtccaaagaatttcattgagattttcgcaaattattcaattaaatcaatgaatttgagagcttgaagaga

SEQ ID NO: 67557 - DNA, 2450 bp, Homo sapiens
  misc_feature (269)..(269): n is a, c, g, or t
  misc_feature (695)..(695): n is a, c, g, or t
attagtgggcctgtagactgacttacccaatctgctggtatttgtctgcccatgagcaggacggtatggaactacgtaagtttgagggggaagagggaggcaggaaacctttgccatgcagtggactagccacggaagacagaccctcaggtgctcctgaggaatggaggttggaacagcaggagcaggaaggaagaaggccttgctggggaaggcctcgggtctcacacagtcccgtctaccactctgtggaagtgagcctgaggccnggacaggaagagccacactggagagctgaatatataagaaacgcatcttggccagaatagaaggcacaacctggagtgtaactaaagatgaaactttccctggagagtttgctgatggacacccataaatgtccagatactactcactggttaaggaatctgacctctggaggcctggaaatccactcctttttgtcagcatgccttctcctgtgctggggagggagaggcctccttagaccctcgggtcccactccctgcttagagttgtgctgtatcacccattggtccttccagcatcatgcccctgtcctgttctggagacgtgggagactcccatcgcctgtcctccttgcctgccaggggaaggcttcctgcggggcccctctccccggtgcagcctcacgtcttaccgctgagcaatgncgtctccactccagcctctttgaaacaccagcaccccctgctctcctgccttgctgcctttgttcatgacatttctcaccagcggccaaccagctccaacctctccactttcgcaagagctgggagatcccacttctggaagctctctgtgaccatcccaaccagaagcaccgtgtccctcccctgagctccagcactggccccgtgccggcaccactctttagtattttatattactttgctttctgtgcacatttcttacttccacatgtagctgactagcaccttggaggcagcagccgtatttttcagtccccacacctctagcactgtgcttaagtgagtgtttgagtggttcttaggattctcaataaagtggctgagttgccatgacccaggagagctcctggcgctgtcaccagagtgactctcagcgtggatccacaaatgaggaaacaccagtgagttctgtgctgtgctgcagaggtgtgggaaagagtggtgtcattgcgagcagaatggtggtatactcggtagataaacgtggaaatttgtaaccagatggcttcagtcatcggcaggttcactgtaaacataaaagctttagtccttgagccaaggggatggaatctatcagacctcaaggaaagggaaacctgctctgtgttctgaaaatgacctagaggtatccctcttgataaactggcaggtgggagggcagaggtaatgtggtggaagttttcttttcttttagttttatttccttattttgggaataggtaattatagtcacatggtttaaaattcaaaagttacaaggggatataaatgtctccctcccaccttgtccccagaggtggctgtttcgatcagagccttgtttctagacgtgtgtgtgtgtatgtgtacgcatgtgtgtgtatgcacaagtagttttgggttctcttttcttggtggtgtacagaagggtagtcaaagcccgactcatgatccctaactcgagtcttttaatgggattgtgtcctaactgcaaaacccgcctcaccaactttgttataaactccccgggtttatagggacagtcatctactgtcccttcctaacagcatggtgcagaaacactccataaatgagtcttgtgttgaatcagattgaattaagtgagaaaggaatggcggtgaaaaatgtggctttagtcatcacatgggcctacgggtttgtgaaagtaacattgagtctccttgtgttctgtgtgtactgcatgtatgtcatcttgcatctaaggatgtatattacccataaaggagcatgcagacacatgagtgcatcttggcttgccactaactgcctgtggccttggggctgtcactcaacttttcatctggaaattgagaataataatactattatccttctggaattgtgtgcataaatgcacagggcctggctcataaaaagtactcagtgagggccgggcgcggtggcgcacgcctgtaatcccagcactttgggaggccgaggggtgcagattacgaggtcaagagatcgagaccatcctggctaacacggtgaaaccctgtctctactaaaaatacaaaaacaaaattagccgggcatggttgcggtgtgcctgtagtcccagctactcaggaggctgaggcaggagaatggcctgaacctgggaggtggagcttgcagtgagccgagatcgtgccactgcactccagccggggtgacagagcgagactccgtctc

SEQ ID NO: 67558 - DNA, 681 bp, Homo sapiens
cacctgactttgccacaaaacattctccacagtcaatgcccatcacgtcagggaacatttttttaagtggttctattttgaggcctgctaaaaagattccagtcttttagaatggatctgcttggccccctttcattcagtccctgaccgtacgatcgcccacatgcctgagctgacgcggggcctgcgtcccacatgctctgggctcacttcccctgctccactgtcaggctaagaatttgcaagtccacagaacaacttgctgagaaaatacccaaaggcctatgtcttgtttattaaatcatttttgatgaacgtgcgctgattgcacacagaccctatcacgagacaaacacttctgaaactgtgctcttacttcatgtcttttgaataaagaaattcagcaaatgtacccataggaaggcatgggccctaccaaatacttgcctggatgactgaattcacctacagcccatcaacgtatccatttcattgagtgcttattttcaaatacattattgcttcccaagagaaagcatacccaccttacactggaaagcactttatagtttgcaagaaatccttttaatgatcatgaattaaagtggggaagatatgttgcttacattgctttacaaatacagaaaatgagatttgttcaagtttacgcagagactcaat

SEQ ID NO: 67559 - DNA, 397 bp, Homo sapiens
ccagctgctgggcaggttgaggtaaggagtttcaaactagcagactgcaaagtggaggacagggaagggtattccaggcagaggaagcaaaggcctgaagtcaaagaaagcacagtcaattgagaagttgtagtcatttcagaaagatatgaatgaaggatgtttacattatccagtttttggtgactattgttttgctacttcactagtgtatattattgagatttgactatacttgctagagcacagaaagttaaaggctttattttatagcaataattctcttttaaggtgaagacatcagaaattatacttcctgtccagagattctaaggagaaaatgtaaattaaacctgacctttgagttagcaaatgattgataactctctgtcctata

SEQ ID NO: 67560 - DNA, 997 bp, Homo sapiens
  misc_feature (27)..(27): n is a, c, g, or t
  misc_feature (872)..(873): n is a, c, g, or t
  misc_feature (889)..(891): n is a, c, g, or t
  misc_feature (896)..(896): n is a, c, g, or t
  misc_feature (907)..(908): n is a, c, g, or t
  misc_feature (915)..(915): n is a, c, g, or t
  misc_feature (924)..(924): n is a, c, g, or t
caagaaaggctaggtcgagcctggttnaatcggccgaggtgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaacgaggctnnatcacttaggccgccnnnggccntacgtgttgannatttgtntgggggtgnaaaaggctgctgggtcaaaacaaaataaataaaagaaaaacaacttttgggaaaaagtggggaactaaggacg

SEQ ID NO: 67561 - DNA, 244 bp, Homo sapiens
  misc_feature (79)..(79): n is a, c, g, or t
ctatgatctgagcaagcaggagataacattttcttctgcatcaagtgaggaaaaatgtgcttttggccatgtctcaaanacagagctctgccgaattcggcacgagggaacatggagctgtcatcactcaacaaaaaaccgaggccctcaatccaccttcaggccccgccccatgggcccctcaccgctggttggaaagagtgttggtgttggctggggtgtcaataaagctgtgcttggggtc

SEQ ID NO: 67562 - DNA, 1507 bp, Homo sapiens
acttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtcaaaaaacaaaaaaaaaaaaaaaaaaaaaaaaaaaaaaaacacaaaaaaaaaaaaaaaaaaaaaaaaaaaaaaaaaaaaaaaaaaaaaaaaaaaaaaaaagcaaagggggggggggcgcgcgaaaaaaatctccccggcggggggcccgcaattgtgaccgccccaccctgctgtttgttggtgcaacagcaggcggcccccctatgagggggccatccaataatatagacgcccgagcgggaggggggggtgatttaaaacaccggtggggtgaggggagaacatcgtcattgagtgagggatcttgttgtggggcgagcaccccaccatctgtgggggggggggaggcaacacagagtggtggggagccaatcaaaccgcgaacagacaaataataagcggctggtgggggagattaatataacatgtgtgagcaggtgtaggtgtgcggagacaccaccaggctgtataatgtcggtgtgaaaaaatgtgatgtggaggggagttttgaatttgaaaatattgagagg

SEQ ID NO: 67563 - DNA, 1028 bp, Homo sapiens
acttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtctccgataatctgaaccaataaccgaatcccctcgtggggggggcccgggcc

SEQ ID NO: 67564 - DNA, 937 bp, Homo sapiens
  misc_feature (875)..(875): n is a, c, g, or t
acttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaacgggcntcatacttaggccgcccatgcctaacgtttgaaagttcggtgggggtcaaagcgtctggcca

SEQ ID NO: 67565 - DNA, 977 bp, Homo sapiens
acttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtc

SEQ ID NO: 67566 - DNA, 953 bp, Homo sapiens
  misc_feature (27)..(27): n is a, c, g, or t
caagaaaggctaggtcgagcctggttnaatcggccgaggggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtc

SEQ ID NO: 67567 - DNA, 751 bp, Homo sapiens
  misc_feature (1)..(1): n is a, c, g, or t
ngtcactctagaggattcccattggatatgcggatatgggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtc

SEQ ID NO: 67568 - DNA, 1002 bp, Homo sapiens
  misc_feature (877)..(878): n is a, c, g, or t
  misc_feature (894)..(896): n is a, c, g, or t
  misc_feature (901)..(901): n is a, c, g, or t
  misc_feature (912)..(913): n is a, c, g, or t
  misc_feature (920)..(920): n is a, c, g, or t
  misc_feature (929)..(929): n is a, c, g, or t
acttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaacgaggctnnatcacttaggccgccnnnggccntacgtgttgannatttgtntgggggtgnaaaaggctgctgggtcaaaacaaaataaataaaagaaaaacaacttttgggaaaaagtggggaactaaggacg

SEQ ID NO: 67569 - DNA, 489 bp, Homo sapiens
caaaatgctaattattattattagtgctcatagttagagcaaaccaatatggcttagtgctcctttgtccttctgatgattgactattttgactgtcttccccaggctcctggtccccaccccacccccagggcaagcaagtgccttcacagacctcttcagcaccttccgcgcccgcccatcccacacttgcactcgataccagtcggttcagggaagaagggagcaagcttggaaagatggtgcaggttgccatggcaatgatgggggaggaggggtggatgcccagcagagcctggccaaggattcagggcagagaaagctcacttcattaccatattttactacactggcccagtctgccgacggttgcaccccagaagtgccttggtatcagaggcgagtagatggagggcaggagttggggaaaaggagacattgagaaggctgttggcgagaagaaggccaaggtctgtggaaagtagaagg

SEQ ID NO: 67570 - DNA, 458 bp, Homo sapiens
ataatagtgaaaaactggaattaaatatccattaataggaggatacaaatcaatgtgtttgatttattgataaaagaagatgaccacgctagattaagcgacaagagttggttgctgaagagtatgaatggacattattgtcccatagaactgtctgcaatgatgaaaatagtctatacctgtgtggtcctatacagtagccgctagctacttatggccactgagcacttgaaatgtggccagtgtgacaggggatctcaattttaaattgtatttaactttactaaatctaaatagccacatgtggctagtggttactgtgttgcattgcacagcagtagaatgtaagcccagcgggaacaaagatctttaattacaatgaattggaacttcccaaaacagtgcttgtgcttggcatatggaaggagctcaataaatagttgctgaatgaaacaatt

SEQ ID NO: 67571 - DNA, 353 bp, Homo sapiens
tgtatcactgccacattgcttgtctgaagcgaagctgactcactttgttatcataagtgatcttaccaaagaccaagttgtccagttgccttggagtgtaggtcatgcgttgccggtaccctggggctgtgtacaatggccaggctgaggggaccttgtggttacccccatgggacttgtaacttgtcaagtgggaaggtggtaccaagtgaagaagggtagggtccttggttttggcctcacgtggttcttcccagaatgaatggtgaaaaaattataattctgcagaaaaatttaaattctattttgtttactttttggatgggagataggtgtacacatggcactaaaat

SEQ ID NO: 67572 - DNA, 345 bp, Homo sapiens
tagagcatctgtgtgaattactttttaacttaaattccagttagcctcttagggatttttaggaaaaaaaaatctgctgtcgtgatttatacctaacgaaggagtagtgtcatgagtgtgtaaaaaacgacatacaaaggggaatagaacagagtagagaaggtgaataactactaaatctgcaaggaacacaaggtagtgtggtgttgatattttctgttaggagatatacccatttgttcctttagatcatatgccttatatgagaaggtgacgttacataaatatggtagctgagtctgggtctcagctaggaaatgctgattggataaaaaatttgacttt

SEQ ID NO: 67573 - DNA, 869 bp, Homo sapiens
gaacatgaggtggtagtaaatggatgcatgtgagtgtgagtgctggcctaccgtgtgcatcgggacccaaaggaaaggaatcaggaccagaattcacctgcagaacatttaagttggaaatgtcttgttgcctgtggtttggtctaatactgaaatcagccttaagtcaaaatctttcaggtagttgccataatacgcacgcattgaattataatccccataacataaaaacctcaaagttctagtacagacaaccagagagagacctcggtctcgattcgattttcttcctgactcaaccttgtgcttttaagcggatctctcctattctcttcttctttgaagtggctgacagtgctgacctgacaatcacagacactagaagatattaatgagacaatgcacataaagtaataaagtaaggcttttttttggcacaacggtgttataaaagttactgatttatcaagataccttgttttcatatgtgtgtgtttcattcagttcacacaacaatcctgtgaattaattggctgtgctggaacctgaacctggaattcctacctactcatccattatttattctactgtacaatacttctctgcttccagtactggcagactaatttgacgtttagtcaagctgccacatgcagttgcatgggttgtgcactgcaccatatctgaggggtaacattcatatcagagacacgcatttattatggcagttttctggaaggtggcaacactatatcttgttttgtcttcttaaaatttgtttattctgatgattttctgtggggtggatagaagtaaagtatcttaaaggatttgcacttgttactaattcacagaaagttattgcatgg

SEQ ID NO: 67574 - DNA, 275 bp, Homo sapiens
aagtttagggacaaagtagcttcctcggtttgctgtatatggtgtaaaatataaggtaaaaccctcatgtttgtacattgaactgatttgtttctgtgccatttcccattagtttttgtcttaggcaattaggggaaggcaaattatttttactcattttaaatgtcaatattacatatgttacaggatatgtaatggattttccattctatagtctgtgattttttttttctaatgggattgcctgaataagacaaaatgtttttaagttaatt

SEQ ID NO: 67575 - DNA, 257 bp, Homo sapiens
ggcacgacacccatgttgtcatggcttaatatcagagttagcatcaaggagccctccaaagaggaccacaacgaacaccaccgacagtacttcagagttggtgttgaccctgatcaagatccaccacccaacaatgacagctttcaagtcttacaaggggacagcccagattctgccagaggaaactggacaaaacaggagagcacatggatattcaggcggtggtacagctttgatcacaattacctgaagcccat

SEQ ID NO: 67576 - DNA, 2361 bp, Homo sapiens
  misc_feature (1244)..(1244): n is a, c, g, or t
  misc_feature (1647)..(1647): n is a, c, g, or t
gggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagcttcagcagttgtactcttttttgatgacctaaaaagggcttatttctgaggaatgaaaggttcccatcattgactacggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcataagaaatcctttaagagttcaaatgtccctggaacaggcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcantgaaagagtgcaaacatcgggtccttgtgacttcaacggactcttccaaattgtatgaatgtatcaatgtattagataaacccagtttcagaatgataaagaaaaaatgttagaccaaataatgcggctagttaacagtggtacgatttctcgcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctgtggattaaatcacatactggcatatttaagctgaatgtcaatctggaaaataaattgactgtattaacggaaataccactctttgtgtagatatttgtcgtatattnaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagagggcaacattggaaggttagagttcatcagaaacagaattctaaaatgtgagttcaattcaataaatttgaatttctgtaggaagaatcaaatcaccgatttaaagattgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaacggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgc

SEQ ID NO: 67577 - DNA, 355 bp, Homo sapiens
gattttaaaatatgaatactgtaaaggaaataaacggtgggaaggaaaagtagagaaagaaatgttttaacttatttcagaacattaagatagcagttacattgtttaatagttaaaacattttaaaatatgaatactgtaaaggaaataaacggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgc

SEQ ID NO: 67578 - DNA, 1422 bp, Homo sapiens
tcactaatattttttcagaagatgacgcctcatttagaggataaaatattttaagttattttgatattcaagaggagcattattgggactgtttcagattttatcaccgtgatgtgttaaccctattgccaaatattctctaacatgtacccagtgaattcacacatcttgctgagcttctgaaaacaataggttctttccaaaggggatcaagtggccctgggagacccggcaacaaaccaaaaagaagggctgttgctgtgtctgtttacaacttttccagatgctggcagtacctgtggacttaaaagtgttttttagaggatcgccatggttattgatcactactttatgaactaaacagcattttccagaaaaagggggtttaacttgttacagaattggagaagtctttgcaaaggactgatttaagcccttctacccaacaccttcccctgtgtagatttgcatacagctaaatctaaaatattctgctaaagactattggatgtatggttgatgggatgaaacctttgattaaatttccttttggtggagacatcctgtggtaggtacagataatccaacaagagtccccatttctttgagcttaaaaaggacactgtcgagtaggtaggaggaaacctggcagagccccttatttttggcctaaaaggactgagcaccaagatgtcttttgaagttttaagctaagaggtttccagtgcaatacaatatatacaagtgaagtttttacctcagttttgcaatggactgcaaactatacttattacaccactacaccttctctcaagcctgccagggcctccatttatgtatgtggcttacagcttaaagtcagtagttggactactatatgaactgttactatcatgttttataccggtcgtaaatgcactccccaaactacaggaaagcggtatgtttattttttaaaccagcttttaattttcttagtattatttattgtagatgcaactgtttttattctgttggggggcttgggattattgcacttaactttgcagtttgagtgaactgtgttgaaaaagttaatgaaagcagttggtactcagacaaatagctgaaaactagtgaatgctaggttgttatcaagtttttatttgacattaaggttaaaaagatatatttattttctaaatattttggactttttttttgtttaactctttattagctgctaagtaaattgaagtgtatttaatgatgtgttaagttaacccgatttatggaagacagtaaagaacagccctctgtagtcagtaaagtttcaccttctaaagaatatattttgaattagttttatgaactctgttaaaattctgacccattacttgccaatttataaaagcctattttattacaaggcattgtctctgg

SEQ ID NO: 67579 - DNA, 848 bp, Homo sapiens
agggcatttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattcaagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaccacgcccccgtttgaagactaatgcgctaagcggtttaggcccagggggttggcacgggagggccgcttacactacctcccaaccgacaccgcccgagccggcactccactc

SEQ ID NO: 67580 - DNA, 847 bp, Homo sapiens
agggcatttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattcaagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggatcgtctataagtacgactcagagaacttttagagtaactgtctgtgtcgggaaggatccgtaaggaggcaactctatgcaaggtttgagatgggtgagtgtaagtcaccatccccgtttaggaggatcgtggtgctgaggcggttttagcatattgggggttgtg

SEQ ID NO: 67581 - DNA, 768 bp, Homo sapiens
  misc_feature (24)..(24): n is a, c, g, or t
  misc_feature (31)..(31): n is a, c, g, or t
gcggccgctactactactaaattngcggccngcgactgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggttaggttatcttttgtatctttttcttatccaattgcaggtttgttttattatgcaataatggacataaaagcatgctttttgttcaggaattttaggaaccccatttgctttttttgaggcacactttagcagaaatgattgacctaggcctgttgcattaaaagcttacttctatttctaacataagatacacagagttatgttaataatttggttaagtatttatacacctgataacattttgagtctactctgatcacagaatcgtttatttaggttttctatttgttgttttagtcttctgtaagtgaacgactttgtacatgctttctactttacttcataaatggacttttaaccctcatg

SEQ ID NO: 67582 - DNA, 3469 bp, Homo sapiens
tcactaatattttttcagaagatgacgcctcatttagaggataaaatattttaagttattttgatattcaagaggagcattattgggactgtttcagattttatcaccgtgatgtgttaaccctattgccaaatattctctaacatgtacccagtgaattcacacatcttgctgagcttctgaaaacaataggttctttccaaaggggatcaagtggccctgggagacccggcaacaaaccaaaaagaagggctgttgctgtgtctgtttacaacttttccagatgctggcagtacctgtggacttaaaagtgttttttagaggatcgccatggttattgatcactactttatgaactaaacagcattttccagaaaaagggggtttaacttgttacagaattggagaagtctttgcaaaggactgatttaagcccttctacccaacaccttcccctgtgtagatttgcatacagctaaatctaaaatattctgctaaagactattggatgtatggttgatgggatgaaacctttgattaaatttccttttggtggagacatcctgtggtaggtacagataatccaacaagagtccccatttctttgagcttaaaaaggacactgtcgagtaggtaggaggaaacctggcagagccccttatttttggcctaaaaggactgagcaccaagatgtcttttgaagttttaagctaagaggtttccagtgcaatacaatatatacaagtgaagtttttacctcagttttgcaatggactgcaaactatacttattacaccactacaccttctctcaagcctgccagggcctccatttatgtatgtggcttacagcttaaagtcagtagttggactactatatgaactgttactatcatgttttataccggtcgtaaatgcactccccaaactacaggaaagcggtatgtttattttttaaaccagcttttaattttcttagtattatttattgtagatgcaactgtttttattctgttggggggcttgggattattgcacttaactttgcagtttgagtgaactgtgttgaaaaagttaatgaaagcagttggtactcagacaaatagctgaaaactagtgaatgctaggttgttatcaagtttttatttgacattaaggttaaaaagatatatttattttctaaatattttggactttttttttgtttaactctttattagctgctaagtaaattgaagtgtatttaatgatgtgttaagttaacccgatttatggaagacagtaaagaacagccctctgtagtcagtaaagtttcaccttctaaagaatatattttgaattagttttatgaactctgttaaaattctgacccattacttgccaatttataaaagcctattttattacaaggcattgtctctggaaaaaaaaaattcccttaattcttaaatgtcattagatgtagaaagaaaaactaaatgttactaaggattattaagaaatagttttttaactattaagattttaaaaactttcctgtaaagttgcttttaataagtatcaaattttctgtatgatcatgtaaaattcataatttgtgcaaagcagaggaaaaataaattcttaattttgtttagacttaacctaaaatgacatttataagttttaaatatgcagattttagagttacatattgtacaatgatgataggtttttctagtttttatttttcatctgaatggagactttatttgggaaagtgttttaattgttaaaactgatatttagtttgagaatgactttgtttacttttgtttagactactaaaatgtgacttacatgttttgattggactagtctgcaattttctcatcatagcatgagttggcagagaatatctacttccagcagtacatttaaagtttggtttataggaattaatttgagaatcaaaatgtaggaattttaaaataatttgctcactaaaaaaattaagatgttaaataatgggttattctttgtacttatctctgtcagaaactcttgctttactctttgttctcccagcagtttttggtttaatttctaatgtgtctaatttgtgtaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67583 - DNA, 3492 bp, Homo sapiens
tcactaatattttttcagaagatgacgcctcatttagaggataaaatattttaagttattttgatattcaagaggagcattattgggactgtttcagattttatcaccgtgatgtgttaaccctattgccaaatattctctaacatgtacccagtgaattcacacatcttgctgagcttctgaaaacaataggttctttccaaaggggatcaagtggccctgggagacccggcaacaaaccaaaaagaagggctgttgctgtgtctgtttacaacttttccagatgctggcagtacctgtggacttaaaagtgttttttagaggatcgccatggttattgatcactactttatgaactaaacagcattttccagaaaaagggggtttaacttgttacagaattggagaagtctttgcaaaggactgatttaagcccttctacccaacaccttcccctgtgtagatttgcatacagctaaatctaaaatattctgctaaagactattggatgtatggttgatgggatgaaacctttgattaaatttccttttggtggagacatcctgtggtaggtacagataatccaacaagagtccccatttctttgagcttaaaaaggacactgtcgagtaggtaggaggaaacctggcagagccccttatttttggcctaaaaggactgagcaccaagatgtcttttgaagttttaagctaagaggtttccagtgcaatacaatatatacaagtgaagtttttacctcagttttgcaatggactgcaaactatacttattacaccactacaccttctctcaagcctgccagggcctccatttatgtatgtggcttacagcttaaagtcagtagttggactactatatgaactgttactatcatgttttataccggtcgtaaatgcactccccaaactacaggaaagcggtatgtttattttttaaaccagcttttaattttcttagtattatttattgtagatgcaactgtttttattctgttggggggcttgggattattgcacttaactttgcagtttgagtgaactgtgttgaaaaagttaatgaaagcagttggtactcagacaaatagctgaaaactagtgaatgctaggttgttatcaagtttttatttgacattaaggttaaaaagatatatttattttctaaatattttggactttttttttgtttaactctttattagctgctaagtaaattgaagtgtatttaatgatgtgttaagttaacccgatttatggaagacagtaaagaacagccctctgtagtcagtaaagtttcaccttctaaagaatatattttgaattagttttatgaactctgttaaaattctgacccattacttgccaatttataaaagcctattttattacaaggcattgtctctggaaaaaaaaaattcccttaattcttaaatgtcattagatgtagaaagaaaaactaaatgttactaaggattattaagaaatagttttttaactattaagattttaaaaactttcctgtaaagttgcttttaataagtatcaaattttctgtatgatcatgtaaaattcataatttgtgcaaagcagaggaaaaataaattcttaattttgtttagacttaacctaaaatgacatttataagttttaaatatgcagattttagagttacatattgtacaatgatgataggtttttctagtttttatttttcatctgaatggagactttatttgggaaagtgttttaattgttaaaactgatatttagtttgagaatgactttgtttacttttgtttagactactaaaatgtgacttacatgttttgattggactagtctgcaattttctcatcatagcatgagttggcagagaatatctacttccagcagtacatttaaagtttggtttataggaattaatttgagaatcaaaatgtaggaattttaaaataatttgctcactaaaaaaattaagatgttaaataatgggttattctttgtacttatctctgtcagaaactcttgctttactctttgttctcccagcagtttttggtttaatttctaatgtgtctaatttgtgtaggcgtcgaccagaagattatgatattcataacagcagaaagaaaccaaggattgactatccccctgagtttcaccagagaccagggtatttaaaggatccacgataccaggaagtggacagtttcacaaatcttattcccaacaacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67584 - DNA, 2348 bp, Homo sapiens
ctattccagtgtaactcatcataccctatgaattacctgaaattgctaattttgcaaaaatggaaacttatctgcacatgtgtttaaggttaaaagtagttatgaaaagcaataaccttatattctatcaggctttttgttccctatggtagttagtgtttcatgtgatacatatacatacaatgctactttttttaaataaaaatctttatgtctttggagaggaatgggaaatactcggtatgtaatctaaatgtagcttttcaattaatctatcccttactgaaatttaagagagcaaactatattcaagaagggatatcatgtatttgaagagagtcagtgatacacttgtgaaacttaggcagttaggagattgatgttagtgatcattatagcactattatgtaacaagtggcttgattagcctcattcttccaaaataggttgtcctgttgtagaaagtgaaaatagtttttccccagtaacatgaccactcaaatgtttttacattttaatttgttgggttcttattaaaagaagcaggggaaagaatatttttctaaccaccatcgatttttcattttcagtgtatacatcttcatttttgcaacttttgcaattttttccccctcccccttaagtttacattttaaaaagcttatctgtggttttcttggtaagacctacatatacccaaggtggaaagtaaacatttgttttaaggaagtcctgtcatagtgtgctcaagatagttcctctgcccttaccttccctgtgaagcagaaggaagaaattttctgattagcaagatttggagtgtgaacatagaagatacctatctgaaagcttctctagcagtttacaattctatgatatcattagttatttcctagattatcatgtaatctgagaagaaaatttgaaaatgggataatacagtagtagcatcacttaaagtacatatttcatggaaagaattgaaacgagtggtaaggaaggtttaattataatgccataaaagaaaaatataaatttgatttactaaaatgcttgatgtttgaacagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67585 - DNA, 2238 bp, Homo sapiens
aagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcattcccgtcgagaaccagtccgggatgtgggaaggcgtcgaccagaagattatgatattcataacagcagaaagaaaccaaggattgactatccccctgagtttcaccagagaccagagggtatttaaagattcacgatccaggaagtgacagacgattttaggaggtcgcgagaagtgttttaaatggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67586 - DNA, 1294 bp, Homo sapiens
ccacgcgtcgcggacgcgtgggtcgacccacgcgtccgccaggaagtggacacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67587 - DNA, 2445 bp, Homo sapiens
aagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggttaaaaaaaaaaaaaaaaggcttttttaaggttctaaaagaaaatttaaaaaaaaaaggggggaaaaaggcttccttaaggttttgtggccaaaaacctttttaaacggggttttagggcaatttttttattataaaaccaaccctttatg

SEQ ID NO: 67588 - DNA, 2243 bp, Homo sapiens
aagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccatccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67589 - DNA, 1433 bp, Homo sapiens
aattggaggaaaaatgtagagctagcctgtgccagaaaaacattgatgacatttagcataattggcagtatatatggataatagttgaaggtcatcactagttaatatctttggcctaaatcttactgaagggatcagatggaaaagtcattaaagttaagtggaaaactgcataaagagatttgaataatctgttgtagatgtctaatgaggcatcatcctttttctaaaccatgtcagcatattaccttctgtgaattaatttattattgcatttctttggattgttctctccgccgattataatacagagacttttctttttttatattttaaaattgtttatataaatttttttttcaaatcagggatccacttaacactatttgcctttttgacatacctaacacatttctttccttttctagcatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67590 - DNA, 2243 bp, Homo sapiens
aagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaactgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67591 - DNA, 1063 bp, Homo sapiens
gcgacgaaggaaatcatccaccctcatatcataatcatgtactcgtttatctctgtatcatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67592 - DNA, 1005 bp, Homo sapiens
agggcatttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattcaagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaa

SEQ ID NO: 67593 - DNA, 2236 bp, Homo sapiens
tcactaatattttttcagaagatgacgcctcatttagaggataaaatattttaagttattttgatattcaagaggagcattattgggactgtttcagattttatcaccgtgatgtgttaaccctattgccaaatattctctaacatgtacccagtgaattcacacatcttgctgagcttctgaaaacaataggttctttccaaaggggatcaagtggccctgggagacccggcaacaaaccaaaaagaagggctgttgctgtgtctgtttacaacttttccagatgctggcagtacctgtggacttaaaagtgttttttagaggatcgccatggttattgatcactactttatgaactaaacagcattttccagaaaaagggggtttaacttgttacagaattggagaagtctttgcaaaggactgatttaagcccttctacccaacaccttcccctgtgtagatttgcatacagctaaatctaaaatattctgctaaagactattggatgtatggttgatgggatgaaacctttgattaaatttccttttggtggagacatcctgtggtaggtacagataatccaacaagagtccccatttctttgagcttaaaaaggacactgtcgagtaggtaggaggaaacctggcagagccccttatttttggcctaaaaggactgagcaccaagatgtcttttgaagttttaagctaagaggtttccagtgcaatacaatatatacaagtgaagtttttacctcagttttgcaatggactgcaaactatacttattacaccactacaccttctctcaagcctgccagggcctccatttatgtatgtggcttacagcttaaagtcagtagttggactactatatgaactgttactatcatgttttataccggtcgtaaatgcactccccaaactacaggaaagcggtatgtttattttttaaaccagcttttaattttcttagtattatttattgtagatgcaactgtttttattctgttggggggcttgggattattgcacttaactttgcagtttgagtgaactgtgttgaaaaagttaatgaaagcagttggtactcagacaaatagctgaaaactagtgaatgctaggttgttatcaagtttttatttgacattaaggttaaaaagatatatttattttctaaatattttggactttttttttgtttaactctttattagctgctaagtaaattgaagtgtatttaatgatgtgttaagttaacccgatttatggaagacagtaaagaacagccctctgtagtcagtaaagtttcaccttctaaagaatatattttgaattagttttatgaactctgttaaaattctgacccattacttgccaatttataaaagcctattttattacaaggcattgtctctggaaaaaaaaaattcccttaattcttaaatgtcattagatgtagaaagaaaaactaaatgttactaaggattattaagaaatagttttttaactattaagattttaaaaactttcctgtaaagttgcttttaataagtatcaaattttctgtatgatcatgtaaaattcataatttgtgcaaagcagaggaaaaataaattcttaattttgtttagacttaacctaaaatgacatttataagttttaaatatgcagattttagagttacatattgtacaatgatgataggtttttctagtttttatttttcatctgaatggagactttatttgggaaagtgttttaattgttaaaactgatatttagtttgagaatgactttgtttacttttgtttagactactaaaatgtgacttacatgttttgattggactagtctgcaattttctcatcatagcatgagttggcagagaatatctacttccagcagtacatttaaagtttggtttataggaattaatttgagaatcaaaatgtaggaattttaaaataatttgctcactaaaaaaattaagatgttaaataatgggttattctttgtacttatctctgtcagaaactcttgctttactctttgttctcccagcagtttttggtttaatttctaatgtgtctaatttgtgtaggcgtcgaccagaagattatgatattcataacagcagaaagaaaccaaggattgactatccccctgagtttcaccagagaccagggttaatattttataatcctgcagatatttgatttcaaattattgga

SEQ ID NO: 67594 - DNA, 977 bp, Homo sapiens
gcaggcagtcgcgctcgcagccgccggcgttgtcaccccccccgcgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattcaagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaa

SEQ ID NO: 67595 - DNA, 847 bp, Homo sapiens
agggcatttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattcaagacaactggtttctaagccactgagctcatctgttagcaataacaaaagaatagttagtacaaaaggaaagtcagccacagagtattgggatatcaagattgaagaaacagcgctgatgctgtcgaaatcgctataagagtgctcagagacctatagatcactgataaccgtgtcgaagggtctgatgagccattctcgccatgttgtggtgcgggactgagcaccaccctcttggaggctgaattgtcctatggtgtttccgcccagggggggtgcactagcacaagcgccgacaggcaaccacc

SEQ ID NO: 67596 - DNA, 710 bp, Homo sapiens
  misc_feature (24)..(24): n is a, c, g, or t
  misc_feature (31)..(31): n is a, c, g, or t
gcggccgctactactactaaattngcggccngcgacccgaagagacgcatggcgctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattcaagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaa

SEQ ID NO: 67597 - DNA, 856 bp, Homo sapiens
agggcatttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaagggatcaaaaagaaaaagtgatcgaatggaatctactgataccaaacgacaaaagccttctgtccattcaagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggacatcgcatcagtatgctcaagaactatagatacctgaacacgtgcggccggtctgaagggcactctgccaatgttgcctggtacgctcagccccccaccccctggaagactaatgtcctaagcggtttacgcacagcgggctgcaccaccagagagggcccgccacacacaccc

SEQ ID NO: 67598 - DNA, 2297 bp, Homo sapiens
aagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67599 - DNA, 1334 bp, Homo sapiens
gtcgggttcactcttgcctagttttgaattacattcttggaactagtttatgaattacctgaatttagtttcacaaatcttattcccaacaacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67600 - DNA, 1352 bp, Homo sapiens
tgataggagtagaaaagcataaacatgttaaatcttagaagatgtgtaattttcgacaaaaagcatattttgaaacaccttaatgccatcaaagtaaatgtctagtacagattcacttgtttgggattggtgttttggatgaagggttctaagaatcgcttgtttacaagggtgttggtagattcttaatgtaaatggttttccttttttagcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggtta

SEQ ID NO: 67601 - DNA, 2662 bp, Homo sapiens
aagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggttaggttatcttttgtatctttttcttatccaattgcaggtttgttttattatgcaataatggacataaaagcatgctttttgttcaggaattttaggaaccccatttgctttttttgaggcacactttagcagaaatgattgacctaggcctgttgcattaaaagcttacttctatttctaacataagatacacagagttatgttaataatttggttaagtatttatacacctgataacattttgagtctactctgatcacagaatcgtttatttaggttttctatttgttgttttagtcttctgtaagtgaacgactttgtacatgctttctactttacttcataaatggacttttaaccctcatg

SEQ ID NO: 67602 - DNA, 2254 bp, Homo sapiens
  misc_feature (2238)..(2238): n is a, c, g, or t
aagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggaatggaacaacctccacaccatccttactatcagcaccatgctccacctcctcaagctcatcccccttactcaggacatcatccagtaccacatgaagcaagatacagagataaacgagtacatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtgggataaaccggccanggggcgaatttcccca

SEQ ID NO: 67603 - DNA, 1192 bp, Homo sapiens
aagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcagatgagaaaaagaaggaaaggaagagagctagaggcatatctccaattgtttttgatagaagtggaagctctgcatcagagtcatatgcaggttcagaaaagaagcatgagaaattatcatcttccgttcgtgctgtccgaaaagatcaaaccagtaaactcaaatatgtgcttcaagatgcaagatttttcctcataaagagtaacaaccatgagaatgtgtctcttgccaaagcgaagggtgtatggtccacgctccctgtaaatgagaagaaattaaatcttgcatttagatctgcaaggagtgttatcttaatattttctgtcagagagagtggaaaatttcaagggtttgcaagactttcttcagaatcacatcacggaggatctcctatacactgggtgcttccagcaggaatgagtgctaaaatgctgggaggtgtctttaaaattgactggatttgcaggcgtgaattacccttcactaagtcggctcatctcaccaatccttggaatgaacataaaccagtaaagatcggacgtgatggacaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccacgataccaggaagtggacagacgattttcaggagttcgccgagatgtgtttttaaatgggtcctacaatgattatgtgagggaatttcataacatgggaccaccaccaccttggcaaggaatgcccccttacccaggatggtgtggaggttgttccat

SEQ ID NO: 67604 - DNA, 563 bp, Homo sapiens
agggcatttcgggagcgggattgtttcgcgcaggaagcaggctccattttagcgccgcccgccgtcgccatctgtttcccttccctcccccatacctagcccgagtctgagccctaacgagaaggctgggcctaggccgctggatgctggagtgaaaggaagggagaaagggaaaaagcgggaagagtcgagaaggctgagtgttaagaggccaagtgcgacgcgcgtatccgggcagacggactgacggacgggcccgtgcttctgccgcggctgcggcgcccgcgcgagtcgcgtctaagcggcggcggcggtggcagcggcggaaaccgaaggggagccatggcggctgacagtcgggaggagaaagatggagaacttaatgttctggatgatattttaactgaagtaccagaacaagatgatgaactgtataatccagagagtgaacaagataaaaatgagaaaaaggatcaaagctacagctcatagcaactatcatgttttaggtacttaccatatacttcacttactaagtactttatttatttatttatttattt

SEQ ID NO: 67605 - DNA, 694 bp, Homo sapiens
atggaatctactgataccaaacgacaaaagccttctgtccattcaagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgaggtagtaaatattattgcagatataaaacagaaagccattctttttgaggctttagaactgtttattcaccctgaccttgtcttttatatgactgctgattccctttttctttaaacatcagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaagatgaagaggtggatgaagatggagaggaggaggaggaagaggaggaggaggaagaggaggag

SEQ ID NO: 67606 - DNA, 1865 bp, Homo sapiens
aaaagcgccagctgaggggccgctgcgggtggagtgcggcggagtcggcctcgcgaccccagcttgatccgccgcctgctgcaccgcgcctccgccgcgttcctgcgcgtcccgagccccgacggccgcgtgagtcccgtccgtgcggggaaggcagggccgggtcggcgccgcctgtggagaggacccggcggccgggcctgcttggagccgggcgcggtggcagcggcggcagcggcggcgacttccgaggcccgggctagacagcgcagggccatggctgaggcggccccggccccgacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctagaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaatgtgtagccagcagggacctaaactttggcaaaaagtgaacacaattcaaatacgaatgaaggaagagccctcagatggaacgaaaggcgatgtgcaaggccatcccagagagacggaagcaggtgcgatactaagcctcagcccaagaataaaagagagttcaactgttactcttttctttcatcaatcccctatcagttagaactgcaggccagttccaaagagtgtttgcttaagattcaaaagtgggtaagtaaaatggatcagtgggaaggataaggtgtccaacagaaagtgtggaggagaaactcttggcctatcaagtgctcctgagagaaaccatgcaatttaacacttcagttaaagaaatacatgagaactgcttgtcatgaccagacaagataggaaaggggaaaccccagaaacgtgctcttcatctgtcagccttttggaccaagaagctgtcactatcacacataagcaccattcccttagagtggatccaggtgttgactataaccagatttactctttgcttactaggttttccattgtcaccattggatgaacctctggtttagccacagttgtgaaaataaatggaagttggttgattgtctagaaagtgcaagaagatggccctgctccttttctgctgaacatttagtattggaaactcctacttcccttttcattaataatgtgtgcaagtttcctattagcggggaaggtgtggggctctgctgggcttctcttgagcatatctgagaaatgatgttcatgtctatctcaaccaggaccagaccctgtgacttactcggtaataacagtccacacaagcctcgttgatattaaaaaaaaaaaaaaaaaaggacctcattccaaatggaatgggaatccctaatttctgctcagattttctctgaggaggggcaggactcctgcccttcctctcatgtcttagcttcttaaactacaaaaagcatcctcagtgactgcctgagggcagctcagtagccatgaacaaaagcatctttctttctcaaaaatattttcttacggacaaggacctctgatgtcaccaaatatg

SEQ ID NO: 67607 - DNA, 5660 bp, Homo sapiens
aaaagcgccagctgaggggccgctgcgggtggagtgcggcggagtcggcctcgcgaccccagcttgatccgccgcctgctgcaccgcgcctccgccgcgttcctgcgcgtcccgagccccgacggccgcgtgagtcccgtccgtgcggggaaggcagggccgggtcggcgccgcctgtggagaggacccggcggccgggcctgcttggagccgggcgcggtggcagcggcggcagcggcggcgacttccgaggcccgggctagacagcgcagggccatggctgaggcggccccggccccgacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctagaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttgagacatgcttgtgttttggaatttcacacccttacaagaataccacattttgaaacccagaaagacctggaaaggagcccagcatgtccatcttttcaaagatacaacaaaagcagaagttacaagaatattgcggagaggttggaaagcaggatttaacctctagttctcttgttctcagagaacagcaggttgatagtagattatgtctctaggtagagacagatacatgagaagagcctccaaaactggaagcccatcataaggcatgagaatgtttaactataaagccttttattagttctttgatagctaagatggttgttggagaaagtgcttaagccactgtttatgttgctgcctcctctctcaaaaccagccaagatctgttcacacacctctgtggctgtctttccctgaaacatggtaactcaagactgcctgcctaggtttcttagattaattattcacataaattttgtttaatattggttgaacaagaaatctgactttaaaagattattaaggagaatattccttaactatactggcttgatttgaaacaggctcttattgccatttaaactgccagaaatctttgccaaggtcctggttaaaaaaattggaaacggttttcttagccccagctttaaaagctagagatctcagagaaatagctggcttaacaatgacagaacagcctaaaatttgtgcctacaccatgttctgagagtcgttcacatcaaattcttatcttttccaagccagtaagttggcttctccattcctggtgtctgatattcttgacaatcatcagcaacaaagatcacagcactttccagaagcatggagcttcagaaagtgccagtgaactcttggtcctcagtagtgagatgataacagtgttataatgcagcttccttgagccatcagagagagtgtatgttcaccctatctggctgtatcccattggcagtggacagattgaggaaattcctagatcactgagagctaagcaccatgcatagacaacagtttgttcttgcctgtgttgcttttagggactttgactaccacatgttcttttcttggggtgatttaatcacctgggagcatctgagtctgctcctaagtggctttgcaactgggcctaagttctgtttcctttatggatctcaaattttcatctgcacaatgaggctgttgaaaggaaaaaaagtgagcctctaggaattattcaaaaaaagtctgtgatacattccttttcctgccaaagttctgtctctgtctttggcttctgtccaggcaaagctaaataagacagcaaagtcaaagcagataaattcttgttgaaacttgactaaaatttatttgatttgttgttttactcccacttggaatcctgaggtagaagacagaatgcagaagtcttacatcttgggcaggaaactggtttattcctatactcttgtttcctctgcttcttcctgaggtctagaacaaggtctggaaatgtttagacaggatattttcttgatgaagtgataaggaaaggacccatttttttgctcatcacctagcccaaccttcactctctctagttatgcataacaacactagaagaaggtgttagcccagctaactttgcttctgggaaggctatgtctgaacatgttgctctgtaggataatcacacttagaaaacatctgctccatgacattcacaataccagggaccatgggagacacaagaaatgtgtgtctgctgtcataacttacagtgaaaaagcccaataatacagaacaagacatgatgggcaataccctagcatattgggattaagagctttctagccagaatctggacctataccatgggaaaatttaggggtgctgggaatcccaaagccaaggttctggcttcattggcaacccactaggaacttgaatgtgagattcagctctagtttgcaccttgatttccccagtgaaaagggagaagagccaaagtattgtctaggtgctgagttcccttttctgagtggatttcaagcatttgccagggtatgctggaggagggactcctaaagtaggtgagatgtgggactaggtaacactttaaatacttttttactcaaagatttgccaagaacacagcttattagtgaaagagacctgtggattgaaatggctgcagatagatcccgcagtcccttctgaaaggaactgtgtagccagcagggacctaaactttggcaaaaagtgaacacaattcaaatacgaatgaaggaagagccctcagatggaacgaaaggcgatgtgcaaggccatcccagagagacggaagcaggtgcgatactaagcctcagcccaagaataaaagagagttcaactgttactcttttctttcatcaatcccctatcagttagaactgcaggccagttccaaagagtgtttgcttaagattcaaaagtgggtaagtaaaatggatcagtgggaaggataaggtgtccaacagaaagtgtggaggagaaactcttggcctatcaagtgctcctgagagaaaccatgcaatttaacacttcagttaaagaaatacatgagaactgcttgtcatgaccagacaagataggaaaggggaaaccccagaaacgtgctcttcatctgtcagccttttggaccaagaagctgtcactatcacacataagcaccattcccttagagtggatccaggtgttgactataaccagatttactctttgcttactaggttttccattgtcaccattggatgaacctctggtttagccacagttgtgaaaataaatggaagttggttgattgtctagaaagtgcaagaagatggccctgctccttttctgctgaacatttagtattggaaactcctacttcccttttcattaataatgtgtgcaagtttcctattagcggggaaggtgtggggctctgctgggcttctcttgagcatatctgagaaatgatgttcatgtctatctcaaccaggaccagaccctgtgacttactcggtaataacagtccacacaagcctcgttgatattaaaaaaaaaaaaaaaaaaggacctcattccaaatggaatgggaatccctaatttctgctcagattttctctgaggaggggcaggactcctgcccttcctctcatgtcttagcttcttaaactacaaaaagcatcctcagtgactgcctgagggcagctcagtagccatgaacaaaagcatctttctttctcaaaaatattttcttacggacaaggacctctgatgtcaccaaatatg

SEQ ID NO: 67608 - DNA, 5197 bp, Homo sapiens
aaaagcgccagctgaggggccgctgcgggtggagtgcggcggagtcggcctcgcgaccccagcttgatccgccgcctgctgcaccgcgcctccgccgcgttcctgcgcgtcccgagccccgacggccgcgtgagtcccgtccgtgcggggaaggcagggccgggtcggcgccgcctgtggagaggacccggcggccgggcctgcttggagccgggcgcggtggcagcggcggcagcggcggcgacttccgaggcccgggctagacagcgcagggccatggctgaggcggccccggccccgacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctagaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttgagacatgcttgtgttttggaatttcacacccttacaagaataccacattttgaaacccagaaagacctggaaaggagcccagcatgtccatcttttcaaagatacaacaaaagcagaagttacaagaatattgcggagaggttggaaagcaggatttaacctctagttctcttgttctcagagaacagcaggttgatagtagattatgtctctaggtagagacagatacatgagaagagcctccaaaactggaagcccatcataaggcatgagaatgtttaactataaagccttttattagttctttgatagctaagatggttgttggagaaagtgcttaagccactgtttatgttgctgcctcctctctcaaaaccagccaagatctgttcacacacctctgtggctgtctttccctgaaacatggtaactcaagactgcctgcctaggtttcttagattaattattcacataaattttgtttaatattggttgaacaagaaatctgactttaaaagattattaaggagaatattccttaactatactggcttgatttgaaacaggctcttattgccatttaaactgccagaaatctttgccaaggtcctggttaaaaaaattggaaacggttttcttagccccagctttaaaagctagagatctcagagaaatagctggcttaacaatgacagaacagcctaaaatttgtgcctacaccatgttctgagagtcgttcacatcaaattcttatcttttccaagccagtaagttggcttctccattcctggtgtctgatattcttgacaatcatcagcaacaaagatcacagcactttccagaagcatggagcttcagaaagtgccagtgaactcttggtcctcagtagtgagatgataacagtgttataatgcagcttccttgagccatcagagagagtgtatgttcaccctatctggctgtatcccattggcagtggacagattgaggaaattcctagatcactgagagctaagcaccatgcatagacaacagtttgttcttgcctgtgttgcttttagggactttgactaccacatgttcttttcttggggtgatttaatcacctgggagcatctgagtctgctcctaagtggctttgcaactgggcctaagttctgtttcctttatggatctcaaattttcatctgcacaatgaggctgttgaaaggaaaaaaagtgagcctctaggaattattcaaaaaaagtctgtgatacattccttttcctgccaaagttctgtctctgtctttggcttctgtccaggcaaagctaaataagacagcaaagtcaaagcagataaattcttgttgaaacttgactaaaatttatttgatttgttgttttactcccacttggaatcctgaggtagaagacagaatgcagaagtcttacatcttgggcaggaaactggtttattcctatactcttgtttcctctgcttcttcctgaggtctagaacaaggtctggaaatgtttagacaggatattttcttgatgaagtgataaggaaaggacccatttttttgctcatcacctagcccaaccttcactctctctagttatgcataacaacactagaagaaggtgttagcccagctaactttgcttctgggaaggctatgtctgaacatgttgctctgtaggataatcacacttagaaaacatctgctccatgacattcacaataccagggaccatgggagacacaagaaatgtgtgtctgctgtcataacttacagtgaaaaagcccaataatacagaacaagacatgatgggcaataccctagcatattgggattaagagctttctagccagaatctggacctataccatgggaaaatttaggggtgctgggaatcccaaagccaaggttctggcttcattggcaacccactaggaacttgaatgtgagattcagctctagtttgcaccttgatttccccagtgaaaagggagaagagccaaagtattgtctaggtgctgagttcccttttctgagtggatttcaagcatttgccagggtatgctggaggagggactcctaaagtaggtgagatgtgggactaggtaacactttaaatacttttttactcaaagatttgccaagaacacagcttattagtgaaagagacctgtggattgaaatggctgcagatagatcccgcagtcccttctgaaaggaactgtgtagccagcagggacctaaactttggcaaaaagtgaacacaattcaaatacgaatgaaggaagagccctcagatggaacgaaaggcgatgtgcaaggccatcccagagagacggaagcaggtgcgatactaagcctcagcccaagaataaaagagagttcaactgttactcttttctttcatcaatcccctatcagttagaactgcaggccagttccaaagagtgtttgcttaagattcaaaagtgggtaagtaaaatggatcagtgggaaggataaggtgtccaacagaaagtgtggaggagaaactcttggcctatcaagtgctcctgagagaaaccttacactggaagcacaaaaagaagacgagaacaacaatgaccagaaagccaccgaagaggaaacgagcaaaccaaccagtagtgaaagcgggaaaaccaccgaaagagaggacacaacaaccaagaagaaacaccaaaagagaggcaaacaaggacacacaaaaagggggaactataaccagatttactctttgcttactagaaaaccggcgtcaaacagaccagaacaatagagacccacagttgtgaaaataaatggaagttggttgattgtctagaaagtgca

SEQ ID NO: 67609 - DNA, 5200 bp, Homo sapiens
aaaagcgccagctgaggggccgctgcgggtggagtgcggcggagtcggcctcgcgaccccagcttgatccgccgcctgctgcaccgcgcctccgccgcgttcctgcgcgtcccgagccccgacggccgcgtgagtcccgtccgtgcggggaaggcagggccgggtcggcgccgcctgtggagaggacccggcggccgggcctgcttggagccgggcgcggtggcagcggcggcagcggcggcgacttccgaggcccgggctagacagcgcagggccatggctgaggcggccccggccccgacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctagaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttgagacatgcttgtgttttggaatttcacacccttacaagaataccacattttgaaacccagaaagacctggaaaggagcccagcatgtccatcttttcaaagatacaacaaaagcagaagttacaagaatattgcggagaggttggaaagcaggatttaacctctagttctcttgttctcagagaacagcaggttgatagtagattatgtctctaggtagagacagatacatgagaagagcctccaaaactggaagcccatcataaggcatgagaatgtttaactataaagccttttattagttctttgatagctaagatggttgttggagaaagtgcttaagccactgtttatgttgctgcctcctctctcaaaaccagccaagatctgttcacacacctctgtggctgtctttccctgaaacatggtaactcaagactgcctgcctaggtttcttagattaattattcacataaattttgtttaatattggttgaacaagaaatctgactttaaaagattattaaggagaatattccttaactatactggcttgatttgaaacaggctcttattgccatttaaactgccagaaatctttgccaaggtcctggttaaaaaaattggaaacggttttcttagccccagctttaaaagctagagatctcagagaaatagctggcttaacaatgacagaacagcctaaaatttgtgcctacaccatgttctgagagtcgttcacatcaaattcttatcttttccaagccagtaagttggcttctccattcctggtgtctgatattcttgacaatcatcagcaacaaagatcacagcactttccagaagcatggagcttcagaaagtgccagtgaactcttggtcctcagtagtgagatgataacagtgttataatgcagcttccttgagccatcagagagagtgtatgttcaccctatctggctgtatcccattggcagtggacagattgaggaaattcctagatcactgagagctaagcaccatgcatagacaacagtttgttcttgcctgtgttgcttttagggactttgactaccacatgttcttttcttggggtgatttaatcacctgggagcatctgagtctgctcctaagtggctttgcaactgggcctaagttctgtttcctttatggatctcaaattttcatctgcacaatgaggctgttgaaaggaaaaaaagtgagcctctaggaattattcaaaaaaagtctgtgatacattccttttcctgccaaagttctgtctctgtctttggcttctgtccaggcaaagctaaataagacagcaaagtcaaagcagataaattcttgttgaaacttgactaaaatttatttgatttgttgttttactcccacttggaatcctgaggtagaagacagaatgcagaagtcttacatcttgggcaggaaactggtttattcctatactcttgtttcctctgcttcttcctgaggtctagaacaaggtctggaaatgtttagacaggatattttcttgatgaagtgataaggaaaggacccatttttttgctcatcacctagcccaaccttcactctctctagttatgcataacaacactagaagaaggtgttagcccagctaactttgcttctgggaaggctatgtctgaacatgttgctctgtaggataatcacacttagaaaacatctgctccatgacattcacaataccagggaccatgggagacacaagaaatgtgtgtctgctgtcataacttacagtgaaaaagcccaataatacagaacaagacatgatgggcaataccctagcatattgggattaagagctttctagccagaatctggacctataccatgggaaaatttaggggtgctgggaatcccaaagccaaggttctggcttcattggcaacccactaggaacttgaatgtgagattcagctctagtttgcaccttgatttccccagtgaaaagggagaagagccaaagtattgtctaggtgctgagttcccttttctgagtggatttcaagcatttgccagggtatgctggaggagggactcctaaagtaggtgagatgtgggactaggtaacactttaaatacttttttactcaaagatttgccaagaacacagcttattagtgaaagagacctgtggattgaaatggctgcagatagatcccgcagtcccttctgaaaggaactgtgtagccagcagggacctaaactttggcaaaaagtgaacacaattcaaatacgaatgaaggaagagccctcagatggaacgaaaggcgatgtgcaaggccatcccagagagacggaagcaggtgcgatactaagcctcagcccaagaataaaagagagttcaactgttactcttttctttcatcaatcccctatcagttagaactgcaggccagttccaaagagtgtttgcttaagattcaaaagtgggtaagtaaaatggatcagtgggaaggataaggtgtccaacagaaagtgtggaggagaaactcttggcctatcaagtgctcctgagagaaaccatgcaatttaacacttcagttaaagaaatacatgagaactgcttgtcatgaccagacaagataggaaaggggaaaccccagaaacgtgctcttcatctgtcagccttttggaccaagaagctgtcactatcacacataagcaccattcccttagagtggatccaggtgttgactataaccagatttactctttgcttactaggttttccattgtcaccattggatgaacctctggtttagccacagttgtgaaaataaatggaagttggttgattgtctagaaagtgca

SEQ ID NO: 67610 - DNA, 787 bp, Homo sapiens
aaaagcgccagctgaggggccgctgcgggtggagtgcggcggagtcggcctcgcgaccccagcttgatccgccgcctgctgcaccgcgcctccgccgcgttcctgcgcgtcccgagccccgacggccgcgtgagtcccgtccgtgcggggaaggcagggccgggtcggcgccgcctgtggagaggacccggcggccgggcctgcttggagccgggcgcggtggcagcggcggcagcggcggcgacttccgaggcccgggctagacagcgcagggccatggctgaggcggccccggccccgacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctagaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaagctcggtaactgtcttttcacagctggctagtttcttctctgctgtccctgtccgaccttccaggtgtaggagtcgccggctgggtctcacg

SEQ ID NO: 67611 - DNA, 1415 bp, Homo sapiens
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 67612 - DNA, 748 bp, Homo sapiens
gaccacgcgtcggacccacgcgtccggttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 67613 - DNA, 1439 bp, Homo sapiens
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaaaaaaaacaatattgaaataaaaaa

SEQ ID NO: 67614 - DNA, 1844 bp, Homo sapiens
  misc_feature (1643)..(1644): n is a, c, g, or t
  misc_feature (1688)..(1688): n is a, c, g, or t
  misc_feature (1706)..(1706): n is a, c, g, or t
  misc_feature (1778)..(1778): n is a, c, g, or t
  misc_feature (1819)..(1819): n is a, c, g, or t
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaacaaataaccgctcgcagagagccggctctcgaggagcatctttgcggcgttctctgtatttcctgaatctgaatgtcggcctgccttgctagattggggaaagtctcctggataatatcctgcagagtgttttccaacttggttccattctccctgtcactttcaggtacaccaatcagacgtagatttggtcttttcacatagtcccatatttcttggagggcttgnntaaattcttttaatcttttttctctaaacctccccttctagctncatttcattcaatttcgncttccatcactgatacccctttcttccagtgatcgcattcgctcctgaggctttctgcactcttcacgtagnttctcgagccctgggctttcagctccatcagctcctttaanggacctctcttgggtgggtattctt

SEQ ID NO: 67615 - DNA, 1025 bp, Homo sapiens
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatccataatgggatcctctagatcaccagg

SEQ ID NO: 67616 - DNA, 1471 bp, Homo sapiens
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtttgtgttagcttacacgttttaaccattcaagggaagagaaatcaaaccaaaaggtattatagctgcaaatgtccttgtattctgtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 67617 - DNA, 1070 bp, Homo sapiens
gctaggagaggctgcggtgataactttattttttactcttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 67618 - DNA, 1029 bp, Homo sapiens
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtattatagctgcaaatgtccttgtattctgtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 67619 - DNA, 1124 bp, Homo sapiens
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggattaacaagtggtggaataacctaagtgatggccagcggactgtgacaggtattatagctgcaaatgtccttgtattctgtttatggagagtaccttctctgcagcggacaatgatcagatatttcacatcgaatccagcctcaagtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 67620 - DNA, 460 bp, Homo sapiens
catttctcgatgtgagtcagttttaatcggctacatagtgagtggcattcgattttaaaaatgtcaacttgggatctgtcaccatgctacttaccatttgtatgtcacactgtttgaatgtcggacctggtttgtttttctccagatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtt

SEQ ID NO: 67621 - DNA, 1265 bp, Homo sapiens
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaagtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 67622 - DNA, 1304 bp, Homo sapiens
  misc_feature (330)..(330): n is a, c, g, or t
  misc_feature (436)..(436): n is a, c, g, or t
  misc_feature (569)..(569): n is a, c, g, or t
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtattatagctgcaaatgtccttgtattctgtttatggagagtaccttctctgcagcggacaatgatcagatatttcacatcgaatccagcctcaaaggtccaaataacaccaaaaaacatacaagcaaacaatacanaagcaccaaaaaacacagaatcaactgaatgaagaaagaataaaaatgatattcaacactgacgctaattcaatggaattgcataactaaatttgagatattcagnaacataatcgaatgaatcctaaacgaacagagaaagaaattgcaatgaatagatacattgaaaacataaggggtgcgacattgaactctgcatttaactaaagaggtagcttcattcagctatttattaacanactatatgatctcgtacaaaatacaatatcccagcatggattgaaaatcattggcttattgaagccaaaggatcgatattaggatgggttggggaggaaaaaaccggtaccctacatggaatcaccgtattctcattcgacatagaatgggggtcctataaaaagggccattattatagccttcctcacaattacatgccaggcctctttaatctattattcccaatttagcaatgcttatccttttttttattcattatcctttcactcacacgggagtttttaagcggtcggttttggtgtgcaaaacggttgaaataaaaacgttttgtcggtatttcctcattgggcgagaacgatgggtttaaacaaaacctgggttattctctttattttattgagttactatattcgaataacatactggttgttaaccaaatgtgtgtcgcggccaatagttgtctttaaattataatttggctcattttgttaaaaagcgagatttttataattcctctgtgtgcgtggggatgcaatttcctttttttcccataaactcctaggccttttttaaacctccttgtgttttttaacaatacctttctgtgaatttggttcccatagggtcaaaaaatggcgtctcctttcttgtttcaatcgttgtgcgagtagtgatttggttgtctccggcggcgggcgaattttttccagctcttgtgtaacgtctgcgggggc

SEQ ID NO: 67623 - DNA, 1754 bp, Homo sapiens
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaaaaaaaaaaaaaaaaaaaaacaaaaaaaaaaaaaaaaaaaaaaaaaaaaaaacaaaacaaacaaaccaaaacaaagcaaacaaaacacactcgcgcagacacaaccacatgacaacgcagagaaaagacaccacagacgagaacaacacacgcacacacgcgagaccggggccggaccgcagccaccaccacgacggacgcggcaccccagccgccccctgcccaccccagtcccacaccacccacgcacgcgccgggacagatcatatcccccgcccacgcgtccgcgcaaccgcaggcaggacggagcccccgcagcagccacagcccctctccccgc

SEQ ID NO: 67624 - DNA, 1313 bp, Homo sapiens
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcagccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 67625 - DNA, 1364 bp, Homo sapiens
cgcagcggaggtagttgcgcagctggggttggtaaggtcgggccatggtggggcagaggttgggaagatggcgtggcgaggctgggcgcactgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 67626 - DNA, 1163 bp, Homo sapiens
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaagtgttatttccaattttgtcagttacgtgggtaaagttgccacaggaagatatggaccatcacttggtgcagccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaa

SEQ ID NO: 67627 - DNA, 1640 bp, Homo sapiens
  misc_feature (1439)..(1440): n is a, c, g, or t
  misc_feature (1484)..(1484): n is a, c, g, or t
  misc_feature (1502)..(1502): n is a, c, g, or t
  misc_feature (1574)..(1574): n is a, c, g, or t
  misc_feature (1615)..(1615): n is a, c, g, or t
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggtttacaggctgtgcatttggatcagctgctatttggcaatatgaatcactgaaatccagggtccagagttattttgatggtataaaagctgattggttggatagcataagaccacaaaaagaaggagacttcagaaaggagattaacaagtggtggaataacctaagtgatggccagcggactgtgacaggtattatagctgcaaatgtccttgtattctgtttatggagagtaccttctctgcagcggacaatgatcagatatttcacatcgaatccagcctcaagtgttatttccaattttgtcagttacgtgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttacttacggtcatgaactgatttggaagaacagggagccgctagtgaaaatctggcatgaaataaggactaatggccccaaaaaaggaggtggctctaagtaagagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaacaaataaccgctcgcagagagccggctctcgaggagcatctttgcggcgttctctgtatttcctgaatctgaatgtcggcctgccttgctagattggggaaagtctcctggataatatcctgcagagtgttttccaacttggttccattctccctgtcactttcaggtacaccaatcagacgtagatttggtcttttcacatagtcccatatttcttggagggcttgnntaaattcttttaatcttttttctctaaacctccccttctagctncatttcattcaatttcgncttccatcactgatacccctttcttccagtgatcgcattcgctcctgaggctttctgcactcttcacgtagnttctcgagccctgggctttcagctccatcagctcctttaanggacctctcttgggtgggtattctt

SEQ ID NO: 67628 - DNA, 727 bp, Homo sapiens
cgcagcggaggtagttgcgcagctggggttggtaaggtcgggccatggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtttaacttctttattcaacaaaaatgcggattcagaaaagcacccaggaaggttgaacctcgaagatcagacccagggacaagtggtgaagcatacaagagaagtgctttgattcctcctgtggaagaaacagtcttttatccttctccctatcctataaggagtctcataaaacctttattttttactgttgggaggtctacctgggttaggtctacctggccaggtagacctaacccagacatcattgttgattctggcaggccaatgcagagccacaggaccaagagctcttcctgtgatagactcatccctataatggcattagagtagactgtttttactttgtatgcatactgcggcatggtatagaataagatagggaccaaagtgaagaaaatcctcagcgtaaacaatgcctgggctgtaaggtggatcccagtgaactcgtgtgcttttttcaggatatggatcagaaagttacctatgtaaggtttcttccttaccgcagcctctaagttaggtctacctggt

SEQ ID NO: 67629 - DNA, 333 bp, Homo sapiens
tcaatcattgctggctgcctcatagctggaatgtcaggtagtcagggtgcaaggcagtggctgctacctccaaagggggaatgttttatctagcctaacttccagtttagaggacattcagcagtaacagagataatgggtagaggaaatgatagcacaggatccatgtgcgacatgctgctaaaccttgggcaacaagtaggttaatctttgtgggactctgtttccacattttaaatgagtcagtgaaactagagggtttccatagttctcccagctctatgagaagctgttatacttcttttacagaaaaccgtagatcatcagtgtttg

SEQ ID NO: 67630 - DNA, 446 bp, Homo sapiens
tgaacatgagtttttgtaacgtgactgaagttgagtttaagtaggaagcgcaggaagttcccaagtgccaggtgtgtgtagctcagagttccttttacagtgaggtgtctctcactgggggagcttccaggatcctgagcagactggacacaatcatctctcccttcctctatgtcaagcactgttacaaaagactgtgagcaaatttccatctaaatattaataattctgaagaagaggcaaaactgttgaatgcaagcgatacctattgttgaagaaacccacaaatttctgattctaagatcaggggatacaacaaaatctacaagtcatttcaaatagcacacaggaatcaaactttggtaaatcatttctgaggcacaattaaatatattgtagcactatgttaattaattatattaaatgtcgattcatcttgaatgtat

SEQ ID NO: 67631 - DNA, 401 bp, Homo sapiens
attaagtaaaatatgtttattatttagttataaattaaaaatatgtattttctattgttaatagattgttcttataccactaaatatataaaccattggaaattttcagtattgtataattacaatggtaaatgagaacagagtagaaacacagttgattgaaaagatgaaaaaggacaagattataaaatgctgtaaggctgggcagcgtggctcacacctgtaattccagcactttgggaggctgaggcgggcaggtcacgtgaggtcaagagttcgagaccagcctggccaacatggtgaaaccctgtttttactaaaaatacaaaaattagcagggcattgtggcaggctcctataatcccagctactcgggaaactgaggcaggagaatcacttga

SEQ ID NO: 67632 - DNA, 470 bp, Homo sapiens
gacccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67633 - DNA, 667 bp, Homo sapiens
aaataaaaacctcccgagttcccttttttccaccattgcccctttttattgccctttttcccgagggggtgtgagggcagccctttttgtaggttcccgtcagtcctttggaataacttccaaatacagaaagaaaaaaaaaaatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67634 - DNA, 835 bp, Homo sapiens
gacccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaaaaaaaaaaaaaaaaaaaaaaaaaaaaggggggggggaaaaaagaaaacccaaggggggcccacgagtagagggagaacacagaataagtgtacacagggggccccaaaagggaggcgcacaactaaaggcaaaggacaggggcacgagcaaaaaaagagaaagaggaaaaaaggaaaaagaaaaaaaggagagacccccacacggggggagcaaaagggaaaaaacacaaaaagagaaaaaaggcaagaggaaaataacacttaagacataaggggggaaaaacggaaaataggcaaaaaaaagtggaccagagataataggaaaatcacacggaaaaaaaaaa

SEQ ID NO: 67635 - DNA, 763 bp, Homo sapiens
gacccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaaaaaaaaaaaaaaaaaaaaaaaaaaaatgtaaattttatttatggggccccgttgggcccttgtcttttaaaacccgcataactttttcctggggcccggattatggctatatttgcccaattcccctattggggagcggtttaaaaaacaatgggccggggtttaacaagggggacgtggaaaaaccgggggttcccaaataaaatcctttagaagaaatcccctttttgagggtggggaaaaacaagggccctaccccctttttctgggcg

SEQ ID NO: 67636 - DNA, 480 bp, Homo sapiens
  misc_feature (1)..(1): n is a, c, g, or t
  misc_feature (17)..(17): n is a, c, g, or t
ngcacgcgcgaacgcgnccgcgtcgaacggctgcgagaagacgacagagcgagcgcagaggggctctcggcccagcgccggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67637 - DNA, 585 bp, Homo sapiens
gacccggcgctccattaaatagccgtagacggaacttcgcctttctctcggccttagcgccatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67638 - DNA, 507 bp, Homo sapiens
  misc_feature (6)..(6): n is a, c, g, or t
  misc_feature (46)..(46): n is a, c, g, or t
  misc_feature (69)..(69): n is a, c, g, or t
  misc_feature (75)..(75): n is a, c, g, or t
cggcgnccgagaactatggatcccccgggcttcaggaccggccgcntcgattacggcttcgagaagacnacaganggggctctcggccttagcgccatttttttggggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67639 - DNA, 452 bp, Homo sapiens
ccggaaattcggccattatggccggggctctcggcttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67640 - DNA, 408 bp, Homo sapiens
gcctactactactactactactaaattagcggccgcttcgacgaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67641 - DNA, 467 bp, Homo sapiens
cactcattacaatcttagtagatacttcgtttaagtcctacctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67642 - DNA, 436 bp, Homo sapiens
cagctggtacggctctgggatgtacggatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67643 - DNA, 424 bp, Homo sapiens
  misc_feature (38)..(39): n is a, c, g, or t
taaattcatcgaatccatgcaataaaagcccaacccannaacccctggatggaaacagaaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67644 - DNA, 409 bp, Homo sapiens
  misc_feature (1)..(1): n is a, c, g, or t
  misc_feature (17)..(17): n is a, c, g, or t
ngcacgcgcgaacgcgnccgcgtcgaacggctgcgagaagacgacagagcgagcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67645 - DNA, 666 bp, Homo sapiens
  misc_feature (524)..(524): n is a, c, g, or t
cagctggtacggctctgggatgtacggatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaaaaaaaaaaaaaaaaaaaaaaaaaaaaaaaaaaaaaaaaaaaaaaaaaaagaaaaacaaaaagaaaanaaaaaaaaaagaaagaagacaacataacaagagaggcggaggcggggccgaggactgagcatatctttctcggcgctggggcgcgaggccatgcaaccaatggcgcctcccacacacttatgtagagagaggggggggcata

SEQ ID NO: 67646 - DNA, 793 bp, Homo sapiens
  misc_feature (537)..(537): n is a, c, g, or t
  misc_feature (716)..(716): n is a, c, g, or t
  misc_feature (737)..(737): n is a, c, g, or t
  misc_feature (750)..(750): n is a, c, g, or t
cactcattacaatcttagtagatacttcgtttaagtcctacctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaaaaaaaaaaaaaaaaaaaaaaaaaaaagttttcgggacgggggacgcggntccaggcacccaacagcactgacggcgaacacttcacgggcgcgcgatgcctcgacaaggcggccgccaccaccacctcagctgccctcgcgggcagcacggcgcggcaaaagcgcacgtcgcctagcgatggcgcggggcggggacacgggctgtaccggcccgtcggaaacttccgnttccggggcccgccgcatcgntctcccggcttanaaggcccggttctgacgcgcagtgccagaccttacccctacgg

SEQ ID NO: 67647 - DNA, 654 bp, Homo sapiens
  misc_feature (6)..(6): n is a, c, g, or t
  misc_feature (46)..(46): n is a, c, g, or t
  misc_feature (69)..(69): n is a, c, g, or t
  misc_feature (75)..(75): n is a, c, g, or t
cggcgnccgagaactatggatcccccgggcttcaggaccggccgcntcgattacggcttcgagaagacnacaganggggctctcggccttagcgccatttttttggaaacctctgcgccatgagagccaaggtgagcggttcctggtagtaagcttgggaggtaggagttggcgagtagtagcgaggagacgaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaacagggtcaccaaggtctgccctatagggaggcgtaataccattggcgacgcggccgggaatttagatgggtgtagtaggc

SEQ ID NO: 67648 - DNA, 697 bp, Homo sapiens
  misc_feature (468)..(468): n is a, c, g, or t
  misc_feature (697)..(697): n is a, c, g, or t
ccggaaattcggccattatggccggggctctcggcttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaacaaaaaaaaaaaaantaccccactacattttcccactccctcacattcccacatattttattttaaaaaaaaaaaactcgagactagttctcctcgtgccgaattggcacgagattttggggccgcttttaacctggcctagtgtaactcccttaggcaaaaacctgagcccctggcaatggcaaacctgaaaccaagaaataccgtatgtttaacccaacccaaagcctaaattccaaacacn

SEQ ID NO: 67649 - DNA, 679 bp, Homo sapiens
  misc_feature (537)..(537): n is a, c, g, or t
cggacgcgtgggtcgacccacgcgtccggcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaaaaaaaaaaaaaaaaaaaaaaaaaaaacaaaaaacaaaaaaaaagaaaaaaacacacaaaaaaaaaaaaaaaaaaaacaagaaaaacaaaaagaaaanaaaaaaaaaagaaagaagacaacataacaagagaggcggaggcggggccgaggactgagcatatctttctcggcgctggggcgcgaggccatgcaaccaatggcgcctcccacacacttatgtagagagaggggggggcata

SEQ ID NO: 67650 - DNA, 623 bp, Homo sapiens
  misc_feature (42)..(42): n is a, c, g, or t
actagttctagctcgcgatctagaactagtcgccattttttnggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcatcatcttgtctattatgttttttatggttccatcgggtgggggttttctgtcattagagtttgccctgtcactacctgtgctatggagggtatcaaagctataaaggcaacagcccgggtaaaaaacaaagagacaaacaagcaagacacacaaaaaaaaaagaacagaaaaagcagagg

SEQ ID NO: 67651 - DNA, 964 bp, Homo sapiens
agagagtggaaggtgttgagaattgtatggcggttgcgcgccatgagaccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaagaaaaaggggggggagggtgttatgaatattttccttgggagggggctatagctcttaagcgcagttcccgcgagattttgttgggtcagaaaagggggccccaattttagaggaggactgatcttatttgaacggcatagggaagaggtgggcattcgggtgtttaacaaaggttggttaactgggggaaatacactggtgatatgccttgtgggaagctcatgtagtgaagaagggggacgccttaataattttctgggggggggggggaacaatacatttggggcgaaaaatttactcgtagctaggaagtattttataaaaagggtctccatagaagggggtatactattttagcaagaattggttaaaagggtggttattgaagagggttggtgataagaccattatgggttggctgttaatagcatggggtgagcgtattggaagaaagatttgaggaacttggatggaagtttgtagactgtgaggggagaagaatttatatacctacagggg

SEQ ID NO: 67652 - DNA, 613 bp, Homo sapiens
  misc_feature (38)..(39): n is a, c, g, or t
  misc_feature (428)..(428): n is a, c, g, or t
  misc_feature (490)..(491): n is a, c, g, or t
taaattcatcgaatccatgcaataaaagcccaacccannaacccctggatggaaacagaaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcacaanaaaaacaaaacctataaaaacctcaaactcaacgcacaaaactcttctcctcaacccaaaannaaaggaaagattaaatttcttttggggccgcctggcccaaataatttttaaatttgagaaagtttttttctgggccgcaattttgggctattttgccaaattccccttttggagagggggtt

SEQ ID NO: 67653 - DNA, 755 bp, Homo sapiens
  misc_feature (453)..(455): n is a, c, g, or t
  misc_feature (581)..(581): n is a, c, g, or t
  misc_feature (593)..(593): n is a, c, g, or t
  misc_feature (595)..(597): n is a, c, g, or t
  misc_feature (631)..(631): n is a, c, g, or t
  misc_feature (722)..(722): n is a, c, g, or t
tctatatggccggaggtcctttcagatcttatagcagccgttgttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcactccnnnaacccaggggagtaaccaaacttgtttcccaacttaaaaaataggggaaaaaaaacaatattgcaaagaaaaattcttttgggccgcctcggccaagcggattttaaattgaaggaggtttaggcnggcgggccggantnnngccccctgggccaattggccctttgggggggcgnataaacattacttgccccccttttaaaacgcgggactgaaaaaccctggggtcccaaactgaaggggggggaaaaatccccttttcccaantggggggggaggggcccccccccccgcccttcc

SEQ ID NO: 67654 - DNA, 672 bp, Homo sapiens
  misc_feature (1)..(1): n is a, c, g, or t
  misc_feature (17)..(17): n is a, c, g, or t
ngcacgcgcgaacgcgnccgcgtcgaacggctgcgagaagacgacagagcgagcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcagaaaaagaaaaaaaaaaaaaaaaaaaaaaaaaaaaaagaaaaacctacgggggaactcatatatgacggggggcgggaaaaaaagaggggtataagaagagaaggcgcccagagggcccaaaaaggggtgtttccacgtgaacacaaaattatttgttgctcacaaagggggggaaaaactcggcgaagggcaccccaatataaagaggcgccggaaaaaattcgagaaaaacacgggtaccccgttagatcttcacaacaat

SEQ ID NO: 67655 - DNA, 1032 bp, Homo sapiens
aaataaaaacctcccgagttcccttttttccaccattgcccctttttattgccctttttcccgagggggtgtgagggcagccctttttgtaggttcccgtcagtcctttggaataacttccaaatacagaaagaaaaaaaaaaatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaaaaaaaaaaaaaaaaaaaaaaaaaaaaggggggggggaaaaaagaaaacccaaggggggcccacgagtagagggagaacacagaataagtgtacacagggggccccaaaagggaggcgcacaactaaaggcaaaggacaggggcacgagcaaaaaaagagaaagaggaaaaaaggaaaaagaaaaaaaggagagacccccacacggggggagcaaaagggaaaaaacacaaaaagagaaaaaaggcaagaggaaaataacacttaagacataaggggggaaaaacggaaaataggcaaaaaaaagtggaccagagataataggaaaatcacacggaaaaaaaaaa

SEQ ID NO: 67656 - DNA, 1129 bp, Homo sapiens
gacccggcgctccattaaatagccgtagacggaacttcgcctttctctcggccttagcgccatttttttggaaacctctgcgccatgagagccaaggtgagcggttcctggtagtaagcttgggaggtaggagttggcgagtagtagcgaggagacgaaggcaagtccgccatacctcctgaactactgggtttcaagggtgcccaagagctggtgggagagagaaggtagtttgtgagagagctagcggttaagtgctatgggtagagagggtgggcttagaaaagggtggaattctgatcttatgttgggagggtgtccaagttactgatgtagttgttacgaccaatctttcatacttcttggttaagaatctgtccggttctaaagagtgcatttcatatccttgctaagcctactaataagcttcatcccttttttttttttttttttttaattatctgctgcttgtgatcggttgctagtggaggaagaagcgaatgcgcaggtacgttgagactttgccagcccaggaggagggaagttccttggacaaaacttaggagaaacatttggtttggaaatcttaaaagatctttaggagaaaaacgtttgagtgttttctccctggagccaggatttaacagaacagagaacgatagaaccgtagtgcttgttcattttaccacctcattctttatgtggacgtttgatttaatgtgggagggaaaggcaactctggtttgaggtgtattccattcctgtgtctgcttttcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67657 - DNA, 798 bp, Homo sapiens
aaataaaaacctcccgagttcccttttttccaccattgcccctttttattgccctttttcccgagggggtgtgagggcagccctttttgtaggttcccgtcagtcctttggaataacttccaaatacagaaagaaaaaaaaaaatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaaggtgagcggttcctggtagtaagcttgggaggtaggagttggcgagtagtagcgaggagacgaaggcaagtccgccatacctcctgaactactgggtttcaagggtgcccaagagctggtgggagagagaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67658 - DNA, 1457 bp, Homo sapiens
aaataaaaacctcccgagttcccttttttccaccattgcccctttttattgccctttttcccgagggggtgtgagggcagccctttttgtaggttcccgtcagtcctttggaataacttccaaatacagaaagaaaaaaaaaaatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaacaacaccaccaaacacaacacacaaacaataaaaacacacacaccccaccaaacggggcgaggggagaaaacaaaggacacccacgcaggggcaccacaaacaaaacaaggcagacacagaaaaaaagagacaacaacacggcaccacccaaaagggagagacacgaacaaaaaacagaaaaggaaaagggccgacacaaatcaaccaaaacacaacaggaagacacaaaccacgagaaaggagaaaaaaacgaagaacagcggacgaaacaacaacagagcacagagccacaaaaacacgagagacaccagcaacacgaaggagacacgaaaaacaagcaacaaggggctcaacaacaacacacgcagaccggcacaacacgcgcgaaaccacagcaccaaaaacgcgcacacaaccaaacaacaacaaaaggaaaaagagagaaagaacacatcacgcggggaaacgagaacaaaaaaaccaccacagcaacagcacacggcagccaagagcgcgacagacgcaaccagcacaccgagccaccgcgagaaacgaggcaggcagcgagaacaccagagagggaggaggagcagacgaggagggaaggagacgggacaaggagcagcaacgacagagaaggaaaggaggagcgggacgaaaccgccacacgggacgcgagaaagcaggacgacgagagacgaggcgggaggaagacagagagcacgacgcgagcgaacacggcgcgagaaaagtgaagagggaggcagagacaacca

SEQ ID NO: 67659 - DNA, 856 bp, Homo sapiens
  misc_feature (671)..(671): n is a, c, g, or t
  misc_feature (733)..(734): n is a, c, g, or t
aaataaaaacctcccgagttcccttttttccaccattgcccctttttattgccctttttcccgagggggtgtgagggcagccctttttgtaggttcccgtcagtcctttggaataacttccaaatacagaaagaaaaaaaaaaatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcacaanaaaaacaaaacctataaaaacctcaaactcaacgcacaaaactcttctcctcaacccaaaannaaaggaaagattaaatttcttttggggccgcctggcccaaataatttttaaatttgagaaagtttttttctgggccgcaattttgggctattttgccaaattccccttttggagagggggtt

SEQ ID NO: 67660 - DNA, 752 bp, Homo sapiens
aaataaaaacctcccgagttcccttttttccaccattgcccctttttattgccctttttcccgagggggtgtgagggcagccctttttgtaggttcccgtcagtcctttggaataacttccaaatacagaaagaaaaaaaaaaatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaacagggtcaccaaggtctgccctatagggaggcgtaataccattggcgacgcggccgggaatttagatgggtgtagtaggc

SEQ ID NO: 67661 - DNA, 847 bp, Homo sapiens
aaataaaaacctcccgagttcccttttttccaccattgcccctttttattgccctttttcccgagggggtgtgagggcagccctttttgtaggttcccgtcagtcctttggaataacttccaaatacagaaagaaaaaaaaaaatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcatcatcttgtctattatgttttttatggttccatcgggtgggggttttctgtcattagagtttgccctgtcactacctgtgctatggagggtatcaaagctataaaggcaacagcccgggtaaaaaacaaagagacaaacaagcaagacacacaaaaaaaaaagaacagaaaaagcagagg

SEQ ID NO: 67662 - DNA, 500 bp, Homo sapiens
gacccggcgctccattaaatagccgtagacggaacttcgcctttctctcggccttagcgccatttttttggaaacctctgcgccatgagagccaaggtgagcggttcctggtagtaagcttgggagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67663 - DNA, 427 bp, Homo sapiens
agagagtggaaggtgttgagaattgtatggcggttgcgcgccatgagaccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67664 - DNA, 1919 bp, Homo sapiens
gacccggcgctccattaaatagccgtagacggaacttcgcctttctctcggccttagcgccatttttttggaaacctctgcgccatgagagccaaggtgagcggttcctggtagtaagcttgggaggtaggagttggcgagtagtagcgaggagacgaaggcaagtccgccatacctcctgaactactgggtttcaagggtgcccaagagctggtgggagagagaaggtagtttgtgagagagctagcggttaagtgctatgggtagagagggtgggcttagaaaagggtggaattctgatcttatgttgggagggtgtccaagttactgatgtagttgttacgaccaatctttcatacttcttggttaagaatctgtccggttctaaagagtgcatttcatatccttgctaagcctactaataagcttcatcccttttttttttttttttttttaattatctgctgcttgtgatcggttgctagtggaggaagaagcgaatgcgcaggtacgttgagactttgccagcccaggaggagggaagttccttggacaaaacttaggagaaacatttggtttggaaatcttaaaagatctttaggagaaaaacgtttgagtgttttctccctggagccaggatttaacagaacagagaacgatagaaccgtagtgcttgttcattttaccacctcattctttatgtggacgtttgatttaatgtgggagggaaaggcaactctggtttgaggtgtattccattcctgtgtctgcttttcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaacaacaccaccaaacacaacacacaaacaataaaaacacacacaccccaccaaacggggcgaggggagaaaacaaaggacacccacgcaggggcaccacaaacaaaacaaggcagacacagaaaaaaagagacaacaacacggcaccacccaaaagggagagacacgaacaaaaaacagaaaaggaaaagggccgacacaaatcaaccaaaacacaacaggaagacacaaaccacgagaaaggagaaaaaaacgaagaacagcggacgaaacaacaacagagcacagagccacaaaaacacgagagacaccagcaacacgaaggagacacgaaaaacaagcaacaaggggctcaacaacaacacacgcagaccggcacaacacgcgcgaaaccacagcaccaaaaacgcgcacacaaccaaacaacaacaaaaggaaaaagagagaaagaacacatcacgcggggaaacgagaacaaaaaaaccaccacagcaacagcacacggcagccaagagcgcgacagacgcaaccagcacaccgagccaccgcgagaaacgaggcaggcagcgagaacaccagagagggaggaggagcagacgaggagggaaggagacgggacaaggagcagcaacgacagagaaggaaaggaggagcgggacgaaaccgccacacgggacgcgagaaagcaggacgacgagagacgaggcgggaggaagacagagagcacgacgcgagcgaacacggcgcgagaaaagtgaagagggaggcagagacaacca

SEQ ID NO: 67665 - DNA, 548 bp, Homo sapiens
cactcattacaatcttagtagatacttcgtttaagtcctacctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaaaaaaaaaaaaaaaaaaaaaaaaaaaaaaaagggggggggggggaaaaaaaaaatcccgag

SEQ ID NO: 67666 - DNA, 561 bp, Homo sapiens
  misc_feature (1)..(1): n is a, c, g, or t
  misc_feature (17)..(17): n is a, c, g, or t
ngcacgcgcgaacgcgnccgcgtcgaacggctgcgagaagacgacagagcgagcgcagaggggctctcggcccagcgccggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaaaaaaaaaaaaaaaaaaaaaaaaaaaaaaaagggggggggggggaaaaaaaaaatcccgag

SEQ ID NO: 67667 - DNA, 975 bp, Homo sapiens
gacccggcgctccattaaatagccgtagacggaacttcgcctttctctcggccttagcgccatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaaaaaaaaaaaaaaaaaaaaaaaaaaaaggggggggggaaaaaaatcggggggggaactaatgtcaacacacccgatttgtagaaagaggcacaccaaagaaggagtattattaaaccaggagagcgggcggtaaaaccaagggcggagagaaactatagtagggattatgtcgagaaacccctctgggggtcggtatctgcgcaccaccgagaataagggggggagaaaaaatgggttgagtggaaccgcttcggtcttcgattttctttttttatatcctgttgtcttactgtgataatgcatgaccatgagagtgtataagatgatcgtaagataacagatctatgtcgtgactatgttgtctcgttt

SEQ ID NO: 67668 - DNA, 624 bp, Homo sapiens
gacccggcgctccattaaatagccgtagacggaacttcgcctttctctcggccttagcgccatttttttggaaacctctgcgccatgagagccaaggtgagcggttcctggtagtaagcttgggagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaaaaaaaaaaaaaaaaaaaaaaaaaaaagaaaaagaaaaaaaaaaaaaaaaaaaaaaaaaaaaaagaaaaaaaaagggggggggggggaaaaaaaaaatcccgag

SEQ ID NO: 67669 - DNA, 624 bp, Homo sapiens
gacccggcgctccattaaatagccgtagacggaacttcgcctttctctcggccttagcgccatttttttggaaacctctgcgccatgagagccaaggtgagcggttcctggtagtaagcttgggaggtaggagttggcgagtagtagcgaggagacgaaggcaagtccgccatacctcctgaactactgggtttcaagggtgcccaagagctggtgggagagagaaggtagtttgtgagagagctagcggttaagtgctatgggtagagagggtgggcttagaaaagggtggaattctgatcttatgttgggagggtgtccaagttactgatgtagttgttacgaccaatctttcatacttcttggttaagaatctgtccggttctaaagagtgcatttcatatccttgctaagcctactaataagcttcatcccttttttttttttttttttttaattatctgctgcttgtgatcggttgctagtggaggaagaagcgaatgcgcaggctgaagcgcaaaagaagaaagatgaggcagaggtccaagtaaaccgctagcttgttgcaccgtggaggccacaggagcagaaacatgtccccgtacatcgttagaagcttgaatt

SEQ ID NO: 67670 - DNA, 569 bp, Homo sapiens
  misc_feature (6)..(6): n is a, c, g, or t
  misc_feature (46)..(46): n is a, c, g, or t
  misc_feature (69)..(69): n is a, c, g, or t
  misc_feature (75)..(75): n is a, c, g, or t
cggcgnccgagaactatggatcccccgggcttcaggaccggccgcntcgattacggcttcgagaagacnacaganggggctctcggccttagcgccatttttttggaaacctctgcgccatgagagccaaggtgagcggttcctggtagtaagcttgggaggtaggagttggcgagtagtagcgaggagacgaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatca

SEQ ID NO: 67671 - DNA, 701 bp, Homo sapiens
  misc_feature (6)..(6): n is a, c, g, or t
  misc_feature (46)..(46): n is a, c, g, or t
  misc_feature (69)..(69): n is a, c, g, or t
  misc_feature (75)..(75): n is a, c, g, or t
cggcgnccgagaactatggatcccccgggcttcaggaccggccgcntcgattacggcttcgagaagacnacaganggggctctcggccttagcgccatttttttggggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcaaaaaaaaaaaaaaaaaaaaaatgcgggcgcaattcgagcctaattgggcaatttggccttatggggaaggcgattacaattaactgcccgtggtttacaacgtcgtaactggaccctgccgttacccaccttaatcgcttggaactccccttttggccagttgggtatatccggagcccggaccgtcgcctttt

SEQ ID NO: 67672 - DNA, 553 bp, Homo sapiens
  misc_feature (6)..(6): n is a, c, g, or t
  misc_feature (46)..(46): n is a, c, g, or t
  misc_feature (69)..(69): n is a, c, g, or t
  misc_feature (75)..(75): n is a, c, g, or t
  misc_feature (508)..(508): n is a, c, g, or t
cggcgnccgagaactatggatcccccgggcttcaggaccggccgcntcgattacggcttcgagaagacnacaganggggctctcggccttagcgccatttttttggggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcanacaaaaaaaaccttcctctcatcaacttcttccctttcacaaaaa

SEQ ID NO: 67673 - DNA, 1115 bp, Homo sapiens
  misc_feature (237)..(237): n is a, c, g, or t
  misc_feature (771)..(771): n is a, c, g, or t
  misc_feature (931)..(932): n is a, c, g, or t
taatgatcttttttcactgttgctgagaatctttggtttgaattattgaggcaggttctttcagtaagtttgagatataattgccatgtaataaactgcacatgtttttagcatacactttaagtttggacacatacacatatgtgtacatacacaccatcaagataatgaacatacctatcaaaccagatggtttcctcatgcccttttataatttcttcttctcctcacccttcnctgcctgtcactctcctgatccactgatttgctttctcttagaatagacgactttatattatgtacagtttttatataaatggaatcatatagtctggcatctttcaggataattttttcagatccatttatgttgtagggtccatttcactgctgaatagtattccattgcaaggcataccacaagctatttatccatgtgttatttctaccttttggctattgcaattaaaactgccttgaatacccatatgcagattattctttaaacatgtgcttctgtttctttaaatagttaagagtggaatgatcagatcatatgttagtgtacgtttaagtttttaagagactgctaaacctttctcaagtagttatgccatttgacatttccatgagcagtatataagagttgcaattcttctgcatccttgccaattattggtatggtcagtcttttttattttgaccattttaataggtgtgtagtagtatctcatggttttaatttgcatttccctagtgactaatgatgtnttacatggtttcacgtgcttactggccttctttaagcctttggggaagagtctgttcaaatcttttgcctgtttatattggctttattttttatttatttttatttttttttatatagagacagggttttactctgtctcccaggctgaagtgcgtggcnngatcatgtggttttgcaatatttattgaattttgagagtttaaaatttgtaatatatttaatattaaacctattagtgtatttgatattaatactttatatttaatataatgtacatttaaatatataataaaacatttcattttaacagaggtaacataaatacacttcccaatttatggag

SEQ ID NO: 67674 - DNA, 1626 bp, Homo sapiens
ccaccggcaggttgtactcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaaccacaacaaaacagtcat

SEQ ID NO: 67675 - DNA, 1620 bp, Homo sapiens
gcaggcggagtgcctgagtgccctctcactcaaccctctctaccctttgtctgcagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaaccacaacaaaacagtcat

SEQ ID NO: 67676 - DNA, 3978 bp, Homo sapiens
ccaccggcaggttgtactcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctccctgccacagggcccttcctatgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaagga

SEQ ID NO: 67677 - DNA, 1519 bp, Homo sapiens
agtccactggcgtcttcaccaccatggagaaggctggggctcatttgcaggggggagcccaccggcaggttatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaaccacaacaaaacagtcat

SEQ ID NO: 67678 - DNA, 2016 bp, Homo sapiens
ctcaacgctttatacttccaaagggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaagga

SEQ ID NO: 67679 - DNA, 2245 bp, Homo sapiens
  misc_feature (2238)..(2245): n is a, c, g, or t
ccaccggcaggttgtactcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagcacccctattgagcatgcgccggtgtgcaccagccaggccaccaccccgctgctgcccgcttctgcccagccacctgctgctgcctctcccagtgcggcttcgccacccctggccacagctgctgcccacactgccatcgcctccgcctccaccacagcccctgcttcaagtcctgccgacagcccaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtatgtctctagcttggggctctggctttctgagaagaggcaggagggaggaagtgggagccagatgaccaacctctacataccttgccacgctagctttctgacatcctgatcatttttaaaagctggcaaacaccatgatgcctcgatacatcacagtcgaacaaagtttcattcctaataattatttataaaccaannnnnnnn

SEQ ID NO: 67680 - DNA, 2294 bp, Homo sapiens
ccaccggcaggttgtactcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagcacccctattgagcatgcgccggtgtgcaccagccaggccaccaccccgctgctgcccgcttctgcccagccacctgctgctgcctctcccagtgcggcttcgccacccctggccacagctgctgcccacactgccatcgcctccgcctccaccacagcccctgcttcaagtcctgccgacagcccaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacacacacacacacacacacacacacacacgatcattaaaaagtgtatgctctttaagaagaaaagtaaaatatctcaaaggacggtttcaccaccgtcctttattgaatcaatttttctacatttcagagcaagtgtagattctgagggactcctatttgccaaaaagacaaaactagcaaa

SEQ ID NO: 67681 - DNA, 443 bp, Homo sapiens
ccccgcagtggccgcctcttcagcacctgccacccacaccagctacagtgagggccccgccgcccctgcacccaagccccgggttgtcaccactgccagcatccggccttctgtctaccagccaggtaagaggcagagcaggaggggaggctgtcgaaagccatgggcgggctccaggagccacaagagccaagaagtggctctgggggcacatccccagaagaatgggaagcaaggccttgctaatgatgctccgccctccgtcccctagctgtgggtcagaatcctatggagcctgcatctggtctgggggagacaggtgagcaagaaagcggtggatgattctaagggagagcgaaggagagcagagaagtcttctccggaccgggcatggtggctcacacttggaatcccagcactttgggaggctggggcaggaggat

SEQ ID NO: 67682 - DNA, 4298 bp, Homo sapiens
ccaccggcaggttgtactcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcagaccccgctctggacacgaacggcagcctggtggcacccagccccagccctgaggcgagggccagcccaggcaccccaggcaccccggagctcaggcccacctttagccctgccttctcccggccctccgccttctcctcactcgccgaggcctctgaccctggccctccgcgggccagcctgagggccaagaccagcccagagggggcccgggacctactcggcccaaaagccctgccgggctcgagccagccgaggcaatataacaaccccattggcctgtactcggcagagaccctgagggagatggctcagatgtaccagatgagcctccgagggaaggcctcgggtgtcggactcccaggagggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagcacccctattgagcatgcgccggtgtgcaccagccaggccaccaccccgctgctgcccgcttctgcccagccacctgctgctgcctctcccagtgcggcttcgccacccctggccacagctgctgcccacactgccatcgcctccgcctccaccacagcccctgcttcaagtcctgccgacagcccaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctcctgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaagga

SEQ ID NO: 67683 - DNA, 3533 bp, Homo sapiens
ccaccggcaggttgtactcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagctttcccaaagcgatacacttgctttggtcaccagaggaggacagagcttagagcagctgtggagaatctgaagcattctgcggagttcttaagcgctcccctggcaaacaaattgaagtgccaaacagcactcgctgcagggtatttttagagtcatagctgagagcttgttagctaagacccattgggctttcctcaccaaaaaaggaagtgttattccattactagcgtcatggagctacctctgcgcatcagacttcagaccttgaacaaacttaaaaccttcttgggagcccggacgtccaaagagatgtcttctgggagccactgggcaattgccagggctccaggaagggctctggctcaggttgcagacagctgagaaaagatggccctgtcagccaccctctctcagtctgaaacatccaacatccccagaaggcttagctcctttttgaattgtgatgggaaagtagagttgggtttttccagttttgctctgtggtgtgtgagagatttttttaaaggctttgggttgtctttggcctttgtttagctttaagggttcgttagcatgagtgtccagtcgtgtgcatgaatttcaccccaacttgtgactgctcacttatgacgtctcccccagtaccctccatctcaaataggcttggtggcctgtggaaaagaagagagacagagagacagtgtctgaaacaggatggcagaataggctcacatgcccaaactctgggtggggaagaggaaacttactttctgccaccctcagtaagaacacacgaggaggcaggacctcccaccttcaggtctgcatcatccttttcaaatgttcctttaaatgcagcacactgagtttgtacaattgtgttaactgctggaagggacagatgcactgatatatatgcatttgctgttttggccaatattttgaaaatgtatgagctgagttgatctagctattatttaagtatttattgaagtagaggggccttcaaactactttatactagtgatagtttgagttaggtaagcatcttaaagctgtttggtgataaagaaggcagcttagattctgtggttggaaacagtgtagtcgcttccctttttaggaagccctgttaatatgctcattgaaaacatggcattgaagcaggcacttgcgtggatgtttctcacttgagcacgatatttaggctctcttccaactcactctattctgtcctcactcctgttttggatttttctctttgcatgtttgaaatgttttatgggaatgtattagaactcttttcttctaaggactgagacttccaggggattgccatcttacctgtctcttctccatgagggagaaggaagcagctagctatgtccctagctgcaggaagcccctattttttccaagcacgaagccaccagtctcccccagggagcatcaggaagggacatggatgtgctccctgccacagggcccttcctatgccacagggcccttcctacctttggatctgtgagaaggtgaatacaaagcagcaggcagagtaaaatctgctgggactgcctggagatttgtcaggagctgcagacaagtaccttggagcattctgttatttttggaaagttcaaatatgcagggacaaggaggttgctgactgtactgacaggctctaagtcattttctccaaaaactatctattcaattatcaggggctggtcttgaggaagga

SEQ ID NO: 67684 - DNA, 1409 bp, Homo sapiens
ccaccggcaggttgtactcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcagagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagggaaaggtttgaaacggaacgtaacagcccacgttttgccaaattgcgcaactggcaccatggcctttcagcccaaatccttaatgttaaaagctaaaaggctgcctggaatccccccaccccaacaggctggactccctccatccttacccccacacagatctggcatgtgagccccacggtgatgcttgacaatgtataactctgctgggggcacctctgatggccaaccgcagcatttctgtcctctgcccaccccagagctgatgctggggcccagccccctgcagctctgtacccaccaaacctccccagggcaaccctcgccaccccccaaatagcccgtagcccaatcccctgccctctgcacagggccttagctgtagaccagagagggcaggaggggtttgctggcataacaccccagaaccaagggaaatggatgggccgctgctcagtttcccaccatcctcagctcctggcctcatcccctcctagaatgagtcacccgtagatcagggtctggggaagaggctgatccctggcgctgcccggctccctcgctgccctctggagctcagggcagcccggaatagggctctttgaagaggaagtagaagccccagggtaatgaggcagagacccctcctggcagtggtgaggtgggggcatgcaccctcctttctgtaccgtgtgtgctggctccatagttctctcttctgtacatataagcatgcttgttctgaaataaagaagatttgaagtgaaccacaacaaaacagtcat

SEQ ID NO: 67685 - DNA, 2468 bp, Homo sapiens
ccaccggcaggttgtactcaagagctccacgcagcccggctgggcagcaagggacagaacagaggcggccgctgacagcaccagcatgtcttacagtgtgaccctgactgggcccgggccctggggcttccgtctgcaggggggcaaggacttcaacatgcccctcactatctcccggatcacaccaggcagcaaggcagcccagtcccagctcagccagggtgacctcgtggtggccattgacggcgtcaacacagacaccatgacccacctggaagcccagaacaagatcaagtctgccagctacaacttgagcctcaccctgcagaaatcaaagcgtcccattcccatctccacgacagcacctccagtccagacccctctgccggtgatccctcaccagaaggtggtagtcaactctccagccaacgccgactaccaggaacgcttcaaccccagtgccctgaaggactcggccctgtccacccacaagcccatcgaggtgaaggggctgggcggcaaggccaccatcatccatgcgcagtacaacacgcccatcagcatgtattcccaggatgccatcatggatgccatcgctgggcaggcccaagcccaaggcagtgacttcagtgggagcctccctattaaggaccttgccgtagacagcgcctctcccgtctaccaggctgtgattaagagccagaacaagccagaagatgaggctgacgagtgggcacgccgttcctccaacctgcagtctcgctccttccgcatcctggcccagatgacggggacagaattcatgcaagaccctgatgaagaagctctgcgaaggtcaagcacccctattgagcatgcgccggtgtgcaccagccaggccaccaccccgctgctgcccgcttctgcccagccacctgctgctgcctctcccagtgcggcttcgccacccctggccacagctgctgcccacactgccatcgcctccgcctccaccacagcccctgcttcaagtcctgccgacagcccaaggccccaggcctcttcctacagccccgcagtggccgcctcttcagcacctgccacccacaccagctacagtgagggccccgccgcccctgcacccaagccccgggttgtcaccactgccagcatccggccttctgtctaccagccagtgcctgcatctacctacagcccgtccccaggggccaattacagtcccactccctacaccccctcccctgcccctgcctacaccccctcccctgcccctgcctacaccccctcacctgtccccacctacactccatccccagcaccagcctataccccctcacctgcccccaactataaccctgcaccctcggtggcctacagcgggggccctgcggagcctgccagccgtccaccctgggtgacagatgatagcttctcccagaagtttgccccgggcaagagcaccacctccatcagcaagcagaccctgccccggggaggcccagcctacaccccagcgggtcctcaggtgccaccacttgccagggggaccgtccagagggctgagcgattcccagccagcagccggactccactctgcggtcactgcaacaatgtcatccggggcccatttctggtagccatgggccgttcttggcaccctgaagagttcacctgtgcctactgcaagacttccctggcagatgtgtgctttgtggaagagcagaacaacgtttactgtgagcgatgttatgagcaattctttgccccgctgtgtgccaagtgcaacaccaaaattatgggggaagtaatgcatgccttgagacagacatggcacaccacctgcttcgtctgtgcggcctgcaagaagccttttgggaacagcctcttccacatggaagacggggagccctactgcgagaaagactacatcaatctgttcagcaccaagtgccatggctgcgatttccccgtggaggctggcgacaagtttatcgaagccctgggccacacttggcacgacacctgcttcatttgcgcagtctgccatgtgaatctggaggggcagccgttctactccaagaaggacagacccctgtgcaagaagcacgcacacaccatcaacttgtaggcggccaaggccgcctgtgctgacgaggcccggagctgctcctgctgctggcaacaaaggattcgggaggctgatgtttcttctgaggggaatggggagagagaggaagcgactgagccctttggaagtataattttaggttttttcttctgtacacagatcgtgcatttgcatagttcagactaggagccaaatgaagactcaaaaccaagctagttattaatccaagactggaattgtacttcagacatttagagcagaattccaagaactcaaaagtgaaaagcaacaagcagcaggaggaggacagagcttagagcagcaggaggaggacgccaga

SEQ ID NO: 67686 - DNA, 1264 bp, Homo sapiens
caggagggatggcttagacagtggggtaggggtgatctggctaaaaattggtagattctggattcataaaacctgtgacccatctagctgttgataagcttcaaatttcaagaagtggacttacatcctgaggctgtgagtctttctctagccagtgatacactgcaaaaagttcaggctttggaatcgaacagcccaagtaggaaacatcatttataacatcagtgactttgagtaagttacttgactttccaagcctgagtttacccatatattaatgggacaaattcatttcaggtctgtttagtgtgaagatcaaatagaacagaagctttgaagtgcctagggcattacccagcaaaatgttgggactcagtaaatattaatctgtccccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctcatgca

SEQ ID NO: 67687 - DNA, 2795 bp, Homo sapiens
tttgcggacacaagatggcggcgcccagcggagtaggggctgcgcttggggtttgctgaagctggctgcctctcccactccccttttgggtgcaaagcgccgctagcgggaagacgggggccgggcggggacaggggcacctgcgtagctggactgagagcctgcgcccagcttacatcgaccccacccggccccggcccgacccgacgcgacccgatccgatccgatcccattccatccgttcctcgtctcctcccggtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttcctcccaaattaatcccagaccccctaaaatattgacaaccttgacaaccccccaaccgaggagccagactttgttttggactaacttccatagccctgtcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaatgtggtctccagtggccatgctttgctgcgccaggcctgtgacatctgtgccattgccatgagcctggtggcttatgtgatcaacagcctggtcaacatctgcctcatcggcactcagaacctcttttccctggtgctggccctgtgggatgcagtgaccgggcctctgtggaggatgacagacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctcatgca

SEQ ID NO: 67688 - DNA, 2621 bp, Homo sapiens
  misc_feature (24)..(24): n is a, c, g, or t
  misc_feature (32)..(32): n is a, c, g, or t
  misc_feature (34)..(34): n is a, c, g, or t
taggctaggtacgaggctggtgtnaatcggcngngcgacccgatccgatccgatcccattccatccgttcctcgtctcctcccggtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttcctcccaaattaatcccagaccccctaaaatattgacaaccttgacaaccccccaaccgaggagccagactttgttttggactaacttccatagccctgtcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaatgtggtctccagtggccatgctttgctgcgccaggcctgtgacatctgtgccattgccatgagcctggtggcttatgtgatcaacagcctggtcaacatctgcctcatcggcactcagaacctcttttccctggtgctggccctgtgggatgcagtgaccgggcctctgtggaggatgacagacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctcatgca

SEQ ID NO: 67689 - DNA, 2872 bp, Homo sapiens
tttgcggacacaagatggcggcgcccagcggagtaggggctgcgcttggggtttgctgaagctggctgcctctcccactccccttttgggtgcaaagcgccgctagcgggaagacgggggccgggcggggacaggggcacctgcgtagctggactgagagcctgcgcccagcttacatcgaccccacccggccccggcccgacccgacgcgacccgatccgatccgatcccattccatccgttcctcgtctcctcccggtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttcctcccaaattaatcccagaccccctaaaatattgacaaccttgacaaccccccaaccgaggagccagactttgttttggactaacttccatagccctgtcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaatgtggtctccagtggccatgctttgctgcgccaggcctgtgacatctgtgccattgccatgagcctggtggcttatgtgatcaacagcctggtcaacatctgcctcatcggcactcagaacctcttttccctggtgctggccctgtgggatgcagtgaccgggcctctgtggaggatgacagacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctcatgcaggattaccaaaactggttaataaacctgggggaggggcccggtccccaatttcgacctatactgggtcgtattacaa

SEQ ID NO: 67690 - DNA, 2551 bp, Homo sapiens
agcggaccgcggcgccgatctccggtgcgggggaggccatggcggaaaccttctcaggcccctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttcctcccaaattaatcccagaccccctaaaatattgacaaccttgacaaccccccaaccgaggagccagactttgttttggactaacttccatagccctgtcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaatgtggtctccagtggccatgctttgctgcgccaggcctgtgacatctgtgccattgccatgagcctggtggcttatgtgatcaacagcctggtcaacatctgcctcatcggcactcagaacctcttttccctggtgctggccctgtgggatgcagtgaccgggcctctgtggaggatgacagacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctcatgca

SEQ ID NO: 67691 - DNA, 1262 bp, Homo sapiens
tttgcggacacaagatggcggcgcccagcggagtaggggctgcgcttggggtttgctgaagctggctgcctctcccactccccttttgggtgcaaagcgccgctagcgggaagacgggggccgggcggggacaggggcacctgcgtagctggactgagagcctgcgcccagcttacatcgaccccacccggccccggcccgacccgacgcgacccgatccgatccgatcccattccatccgttcctcgtctcctcccggtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctcatgca
